(12) United States Patent
Mankin et al.

(10) Patent No.: US 7,989,678 B2
(45) Date of Patent: Aug. 2, 2011

(54) **DISARMED *AGROBACTERIUM* STRAINS, RI-PLASMIDS, AND METHODS OF TRANSFORMATION BASED THEREON**

(75) Inventors: Luke Mankin, Raleigh, NC (US); Dwight-Steven Hill, Cary, NC (US); Paula Olhoft, Morrisville, NC (US); Effie Toren, Apex, NC (US); Jeffrey A. Brown, Apex, NC (US); Liqun Xing, Chapel Hill, NC (US); Huihua Fu, Durham, NC (US); Lesley Ireland, Morrisville, NC (US); Hongmei Jia, Apex, NC (US); Hee-Sook Song, Raleigh, NC (US); Allan Richard Wenck, Durham, NC (US); Larry Nea, Raleigh, NC (US)

(73) Assignee: BASF Plant Science GmbH (DE)

( * ) Notice: Subject to any disclaimer, the term of this patent is extended or adjusted under 35 U.S.C. 154(b) by 994 days.

(21) Appl. No.: 11/661,703

(22) PCT Filed: Aug. 31, 2005

(86) PCT No.: PCT/EP2005/009366
§ 371 (c)(1),
(2), (4) Date: Mar. 1, 2007

(87) PCT Pub. No.: WO2006/024509
PCT Pub. Date: Mar. 9, 2006

(65) Prior Publication Data
US 2007/0292953 A1     Dec. 20, 2007

Related U.S. Application Data

(60) Provisional application No. 60/606,789, filed on Sep. 2, 2004.

(51) Int. Cl.
*C12N 15/84* (2006.01)
*C12N 1/20* (2006.01)
*C12N 1/21* (2006.01)
*C12N 15/31* (2006.01)

(52) U.S. Cl. ..... 800/294; 800/288; 435/469; 435/252.2; 435/252.3; 435/422; 435/423; 435/424; 435/425; 435/426; 435/427; 435/428; 435/429; 435/320.1

(58) Field of Classification Search .................. None
See application file for complete search history.

(56) References Cited

U.S. PATENT DOCUMENTS
5,416,011 A    5/1995   Hinchee et al.

FOREIGN PATENT DOCUMENTS
WO    WO-94/02620       2/1994
WO    WO-2005/121345   12/2005

OTHER PUBLICATIONS

Accession No. AP002086 (Oct. 2000).*
Kwon et al. Accession No. AF510923 (May 2002).*
Clerot et al. Accession No. AJ271050 (Jan. 2000).*
"Agrobacterium rhizogenes plasmid pRi1724 DNA, complete sequence", EMBL Database, Accession No. AP002086, Oct. 3, 2000.
Otten, L. et al., "Restoration of virulence of *Vir* region mutants of *Agrobacterium tumefaciens* strain B6S3 by coinfection with normal and mutant *Agrobacterium* strains," Mol. Gen. Genent., 1984, vol. 195, pp. 159-163.
Smith, E. F. et al., "A plant-tumor of bacterial origin," Science, 1907, vol. 25, pp. 671-673.
Hildebrand, E. M., "Life history of the hairy-root organism in relation to its pathogenesis on nursery apple trees," J. Agriculture Res., 1934, vol. 48, pp. 857-885.
Nilsson, O. et al., "Getting to the root: the role of the *Agrobacterium rhizogenes rol* genes in the formation of hairy roots," Physiologia Plantarum, 1997, vol. 100, pp. 463-473.
Van Larebeke, N. et al., "Large plasmid in *Agrobacterium tumefaciens* essential for crown gall-inducing ability," Nature, 1974, vol. 252, pp. 169-170.
Chilton, M. D. et al., "Stable incorporation of plasmid DNA into higher plant cells: the molecular basis of crown gall tumorigenesis," Cell, 1977, vol. 11, pp. 263-271.
Moore, L. et al., "Involvement of a plasmid in the hairy root disease of plants caused by *Agrobacterium rhizogenes*," Plasmid, 1979, vol. 2, pp. 617-626.
White, F. F. et al., "Tumor induction by *Agrobacterium rhizogenes* involves the transfer of plasmid DNA to the plant genome," Proc. Natl. Acad. Sci. USA, 1982, vol. 79, pp. 3193-3197.
Tepfer, D., "Transformation of several species of higher plants by *Agrobacterium rhizogenes*: sexual transmission of the transformed genotype and phenotype," Cell, 1984, vol. 37, pp. 959-967.
Nester, E. W. et al., "Crown gall: a molecular and physiological analysis," Ann. Rev. Plant Physiol., 1984, vol. 35, pp. 387-413.
Lam, S. et al., "Genetic information on the Ri plasmid of *Agrobacterium rhizgenes* determines host specificity," Plant Sci. Letters, 1984, vol. 34, pp. 345-352.
Constantino, P. et al., "Tumor formation and rhizogenicity of *Agrobacterium rhizogenes*carrying Ti plasmids," Gene, 1980, vol. 11, pp. 79-87. Keane, P. J. et al., "Crown gall of stone fruit II. Identification and nomenclature of *Agrobacterium* isolates," Aust. J. Biol. Sci., 1970, vol. 23, pp. 585-595.
Tighe, S. W. et al., "Analysis of cellular fatty acids and phenotypic relationships of *Agrobacterium, Bradyrhizobium, Mesorhizobium, Rhizobium* and *Sinorhizobium* species using the sherlock microbial identification system," International J. Systematic and Evolutionary Microbiol., 2000, vol. 50, pp. 787-801.
Young, J. M. et al., "A revision of *Rhizobium* Frank 1889, with an emended description of the genus, and the inclusion of all species of *Agrobacterium* Conn 1942 and *Allorhizobium undicola de Lajudie* et al. 1998 as new combinations: *Rhizobium radiobacter,R. rhizogenes, R. rubi, R. undicola* and *R. vitis*," International J. Systematic and Evolutionary Microbiol., 2001, vol. 51, pp. 89-103.
Goodner, B. W. et al., "Combined genetic and physical map of the complex genome of *Agrobacterium tumefaciens*," J. Bacteriol., 1999, vol. 181, No. 17, pp. 5160-5166.
Wirawan, I. G. P. et al., "Distribution of a chromosomal virulence gene, *acvB*, of *Agrobacterium tumefaciens* among various bacteria," Biosci. Biotech. Biochem., 1996, vol. 60, No. 1, pp. 50-53.

(Continued)

*Primary Examiner* — David T Fox
(74) *Attorney, Agent, or Firm* — Connolly Bove Lodge & Hutz LLP

(57) ABSTRACT

The present invention relates "disarmed" strain variants of *Agrobacterium* strain K599 (NCPPB 2659), "disarmed" plasmid variants of the Ri-plasmid pRi2659, and derivatives thereof, and methods employing these strains and plasmids in plant transformation.

13 Claims, 23 Drawing Sheets

OTHER PUBLICATIONS

Llop, P. et al., "Tracking *Agrobacterium* strains by a RAPD system to identify single colonies from plant tumours," European J. Plant Pathol., 2003, vol. 109, pp. 381-389.

Sawada, H. et al., "Proposal for rejection of *Agrobacterium tumefaciens* and revised descriptions for the genus *Agrobacterium* and for *Agrobacterium radiobacter* and *Agrobacterium rhizogenes*," International J. Systematic Bacteriol., 1993, vol. 43, No. 4, pp. 694-702.

Zambryski, P. C., "Chronicles from the *Agrobacterium*-plant cell DNA transfer story," Ann. Rev. Plant Physiol. Plant Mol. Biol., 1992, vol. 43, pp. 465-490.

Zupan, J. R. et al., "Transfer of T-DNA from *Agrobacterium* to the plant cell," Plant Physiol., 1995, vol. 107, pp. 1041-1047.

Yadav, N. S. et al., "Short direct repeats flank the T-DNA on a nopaline Ti plasmid," Proc. Natl. Acad. Sci. USA, 1982, vol. 79, pp. 6322-6326.

Wang, K. et al., "Right 25 bp terminus sequence of the nopaline T-DNA is essential for and determines direction of DNA transfer from *Agrobacterium* to the plant genome," Cell, 1984, vol. 38, pp. 455-462.

Wang, K. et al., "Sequence context of the T-DNA border repeat element determines its relative activity during T-DNA transfer to plant cells," Mol. Gen. Genet., 1987, vol. 210, pp. 338-346.

Hernalsteens, J. P. et al., "The *Agrobacterium tumefaciens* Ti plasmid as a host vector system for introducing foreign DNA in plant cells," Nature, 1980, vol. 287, pp. 654-656.

Matzke, A. J. M. et al., "Site-specific insertion of genes into T-DNA of the *Agrobacterium* tumor-inducing plasmid: an approach to genetic engineering of higher plant cells," J. Mol. Appl. Genet., 1981, vol. 1, pp. 39-49.

Horsch, R. B. et al., "A simple and general method for transferring genes into plants," Science, 1985, vol. 227, pp. 1229-1231.

Zambryski, P. et al., "Ti plasmid vector for the introduction of DNA into plant cells without alteration of their normal regeneration capacity," EMBO J., 1983, vol. 2, No. 12, pp. 2143-2150.

De Framond, A. J. et al., "Mini-Ti: A new vector strategy for plant genetic engineering," Bio/Technology, 1983, vol. 1, pp. 262-296.

Hood, E. E. et al., "T-DNA and opine synthetic loci in tumors incited by *Agrobacterium tumefaciens* A281 on soybean and alfalfa plants," J. Bacteriol., 1986, vol. 168, No. 3, pp. 1283-1290.

Joos, H. et al., "Genetic analysis of T-DNA transcripts in nopaline crown galls," Cell, 1983, vol. 32, pp. 1057-1067.

Peralta, E. G. et al., "T-DNA border sequences required for crown gall tumorigenesis," Proc. Natl. Acad. Sci. USA, 1985, vol. 82, pp. 5112-5116.

Shaw, C. H. et al., "The right hand the nopaline Ti-plasmid 25 bp repeat is required for tumour formation," Nucleic Acids Res., 1984, vol. 12, No. 15, pp. 6031-6041.

De Cleene, M. et al., "The host range of crown gall," The Botanical Rev., 1976, vol. 42, No. 4, pp. 389-466.

Smith, R. H. et al., "*Agrobacterium tumefaciens* transformation of monocotyledons," Crop Sci., 1995, vol. 35, No. 2, pp. 301-309.

Van Wordragen, M. F. et al., "*Agrobacterium tumefaciens*-mediated transformation of recalcitrant crops," Plant Mol. Biol. Reporter, 1992, vol. 10, No. 1, pp. 12-36.

Hood, E. E. et al., "New *Agrobacterium* helper plasmids for gene transfer to plants," Transgenic Res., 1993, vol. 2, pp. 208-218.

Suzuki, K. et al., "Mikimopine synthase (*mis*) gene on pRi1724," Gene, 2001, vol. 263, pp. 49-58.

Bush, A. L. et al., "Characterization of an unusual new *Agrobacterium tumefaciens* strain from *Chrysanthemum morifolium* ram," Appl. Environ. Microbiol., 1991, vol. 57, No. 9, pp. 2468-2472.

Byrne, M. C. et al., "Strain and cultivar specificity in the Agrobacterium-soybean interaction," Plant Cell, Tissue and Organ Culture, 1987, vol. 8, pp. 3-15.

Hood, E. E. et al., "Virulence of *Agrobacterium tumefaciens* strain A281 on legumes", Plant Physiol., 1987, vol. 83, pp. 529-534.

Maurel, C. et al., "Alterations of auxin perception in *rolB*-transformed tobacco protoplasts: time course of *rolB* mRNA expression and increase in auxin sensitivity reveal multiple control by auxin," Plant Physiol., 1994, vol. 105, pp. 1209-1215.

Moritz, T. et al., "The gibberellin content of *rolA* transgenic tobacco plants is specifically altered," J. Plant Physiol., 1998, vol. 153, pp. 774-776.

Nilsson, O. et al., "Getting to the root: The role of the *Agrobacterium rhizogenes rol* genes in the formation of hairy roots," Physiologia Plantarum, 1997, vol. 100, pp. 463-473.

Shen, W. H. et al., "Hairy roots are more sensitive to auxin than normal roots," Proc. Natl. Acad. Sci. USA, 1988, vol. 85, pp. 3417-3421.

Ermayanti, T. M. et al., "Stimulation of synthesis and release of swainosonine from transformed roots of *Swainsona galegifolia*," Phytochemistry, 1994, vol. 36, No. 2, pp. 313-317.

Mano, Y. et al., "Production of tropane alkaloids by hairy root cultures of *Scopolia japonica*," Agric. Biol. Chem., 1986, vol. 50, No. 11, pp. 2715-2722.

Sim, S. J. et al., "Shikonin production by extractive cultivation in transformed-suspension and hairy root cultures of *Lithospermum erythrorhizon*," Annals N.Y. Academy Sci., 1994, vol. 745, pp. 442-454.

Cho, H. J. et al., "High-efficiency induction of soybean hairy roots and propagation of the soybean cyst nematode," Planta, 2000, vol. 210, pp. 195-204.

Lahners, K. et al., "T-DNA fragments of hairy root plasmid pRi8196 are distantly related to octopine and nopaline Ti plasmid T-DNA," Plasmid, 1984, vol. 11, pp. 130-140.

Huffman, G. A. et al., "Hairy-root-inducing plasmid: physical map and homology to tumor-inducing plasmids," J. Bacteriol., 1984, vol. 157, No. 1, pp. 269-276.

Jouanin, L., "Restriction map of an agropine-type Ri plasmid and its homologies with Ti plasmids," Plasmid, 1984, vol. 12, pp. 91-102.

White, F. F. et al., "Tumor induction by *Agrobacterium rhizogenes* involves the transfer of plasmid DNA to the plant genome," Proc. Natl. Acad. Sci. USA, 1982, vol. 79, pp. 3193-3197.

Willmitzer, L. et al., "DNA from *Agrobacterium rhizogenes* is transferred to and expressed in axenic hairy root plant tissues," Mol. Gen. Genet., 1982, vol. 186, pp. 16-22.

Taylor, B. H. et al., "T-DNA analysis of plants regenerated from hairy root tumors," Mol. Gen. Genet., 1985, vol. 201, pp. 554-557.

Jouanin, L. et al., "Restriction maps and homologies of the three plasmids of *Agrobacterium rhizogenes* strain A4," Plasmid, 1986, vol. 16, pp. 124-134.

Slightom, J. L. et al., "Nucleotide sequence analysis of TL-DNA of *Agrobacterium rhizogenes* agropine type plasmid," J. Biol. Chem., 1986, vol. 261, No. 1, pp. 108-121.

Vilaine, F. et al., "Independent induction of transformed roots by the TL and TR regions of the Ri plasmid of agropine type *Agrobacterium rhizogenes*," Mol. Gen. Genet., 1987; vol. 206, pp. 17-23.

Narayanan, R. A. et al., "Expression of soybean cyst nematode resistance in transgenic hairy roots of soybean," Crop Sci., 1999, vol. 39, pp. 1680-1686.

Kouchi, H. et al., "Rice *ENOD40*: isolation and expression analysis in rice and transgenic soybean root nodules," Plant J., 1999, vol. 18, No. 2, pp. 121-129.

Bevan, M., "Binary *Agrobacterium* vectors for plant transformation," Nucleic Acids Res., 1984, vol. 12, No. 22, pp. 8711-8721.

Simpson, R. B. et al., "A disarmed binary vector from *Agrobacterium tumefaciens* functions in *Agrobacterium rhizogenes*," Plant Mol. Biol., 1986, vol. 6, pp. 403-415.

Hamill, J. D. et al., "The use of the polymerase chain reaction in plant transformation studies," Plant Cell Rep., 1991, vol. 10, pp. 221-224.

Gelvin, S. B., "*Agrobacterium*-mediated plant transformation: the biology behind the "gene-jockeying" tool," Microbiol. and Mol. Biol. Rev., 2003, vol. 67, No. 1, pp. 16-37.

Robaglia, C. et al., "Expression vectors based on the *Agrobacterium rhizogenes* Ri plasmid transformation system," Biochimie, 1987, vol. 69, pp. 231-237.

Combard, A. et al., "Physical map of the T-DNA region of *Agrobacterium rhizogenes* strain NCPPB2659," Plasmid, 1987, vol. 18, pp. 70-75.

Moriguchi, K. et al., "Analysis of unique variable region of a plant root inducing plasmid, pRi1724, by the construction of its physical map and library," DNA Res., 2000, vol. 7, pp. 157-163.

Moriguchi, K. et al., "The complete nucleotide sequence of a plant root-inducing (Ri) plasmid indicates its chimeric structure and evolutionary relationship between tumor-inducing (Ti) and Symbiotic (Sym) plasmids in Rhizobiaceae," J. Mol. Biol., 2001, vol. 307, pp. 771-784.

"Hypothetical integrase/recombinase protein," UniProt Database, Accession No. Q8KGP6, Oct. 1, 2002.

"Riorf168 protein," UniProt Database, Accession No. Q9F587_AGRRH, Mar. 1, 2001.

Xiang, T., et al., "Disarming of Wild-Type Agrobacterium rhizogenes K599", Hereditas, vol. 23, No. 4, (2001), pp. 336-340.

Deblaere, R., et al., "Efficient Octopine Ti Plasmid-Derived Vectors for Agrobacterium-Mediated Gene Transfer to Plants", Nucliec Acids Research, vol. 13, No., 13, (1985), pp. 4777-4787.

Hoekema, A., et al., "A Binary Plant Vector Strategy Based on Separation of Vir-and T-Region of the Agrobacterium tumefaciens Ti-Plasmid", Nature, vol. 303, (1983), pp. 179-180.

Hood, E. E., et al., "The Hypervirulence of Agrobacterium tumefaciens A281 Is Encoded in a Region of pTiBo542 Outside of T-DNA", Journal of Bacteriology, vol, 168, No, 3, (1986), pp. 1291-1301.

Koncz, C., et al., "The Promoter of TL-DNA Gene 5 Controls the Tissue-Specific Expression of Chimaeric Genes Carried by a Novel Type of Agrobacterium Binary Vector", Mol. Gen Genet, vol. 204, (1986), pp. 383-396.

Lazo, G.R., et al., "A DNA Transformation-Competent Arabidopsis Genomic Library in Agrobacterium", Bio/Technology, vol. 9, (1991), pp. 963-967.

Palanichelvam, K, et al., "A Second T-Region of the Soybean-Supervirulent Chrysopine-Type Ti Plasmid pTiChry5, and Construction of a Fully Disarmed vir Helper Plasmid", MPMI, vol. 13, No. 10, (2000), pp. 1081-1091.

Torisky, R.S., et al., "Development of a Binary Vector System for Plant Transformation Based on the Supervirulent Agrobacterium tumefaciens Strain Chry5", Plant Cell Reports, vol. 17, (1997), pp. 102-108.

Jelenska, J., et al., "Streptothricin Resistance as a Novel Selectable Marker for Transgenic Plant Cells", Plant Cell Reports, vol. 19, (2000), pp. 298-303.

Clerot, D., et al., "Agrobacterium rhizogenes plasmid pRi2659 T-DNA sequence, ORF2, ORF3, OFR4, ORF8, ORF10, ORF11, ORF12, ORF13, ORF13a, ORF14 and cus gene", Database GenBank Accession No. AJ271050, Jan. 14, 2000.

* cited by examiner

I
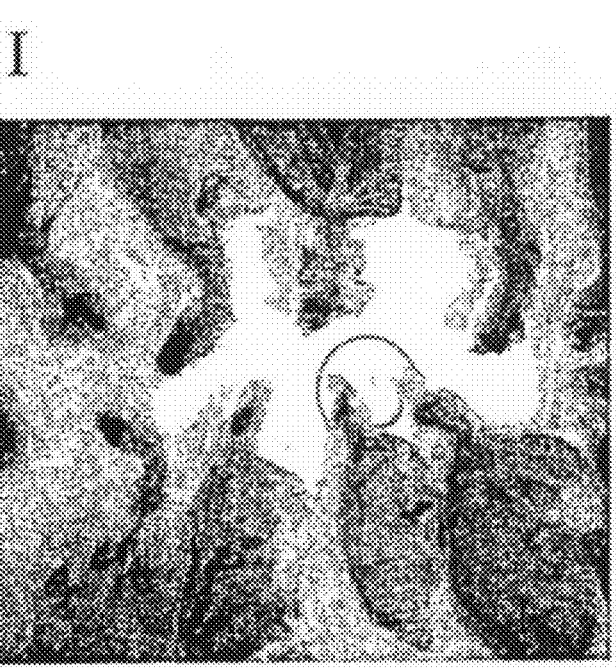
AGL1
II
SHA016
Fig. 3

[a]
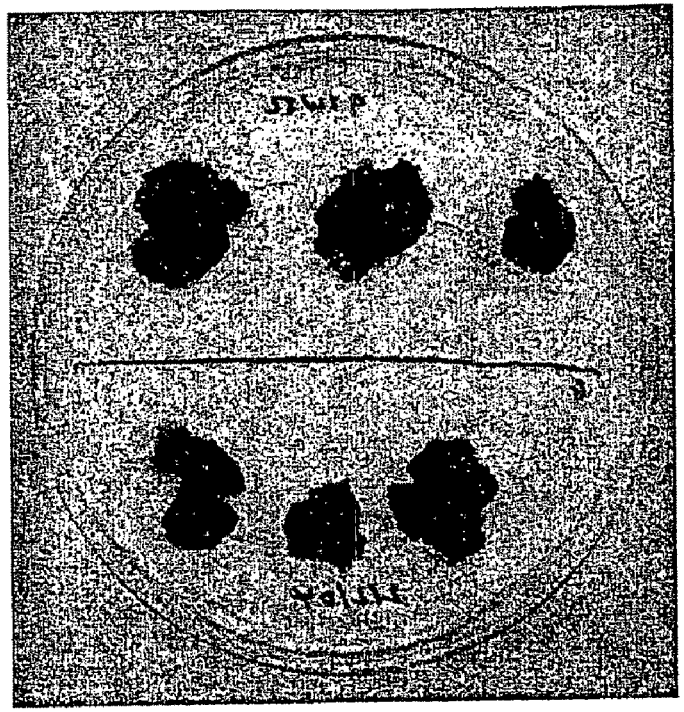
[b]
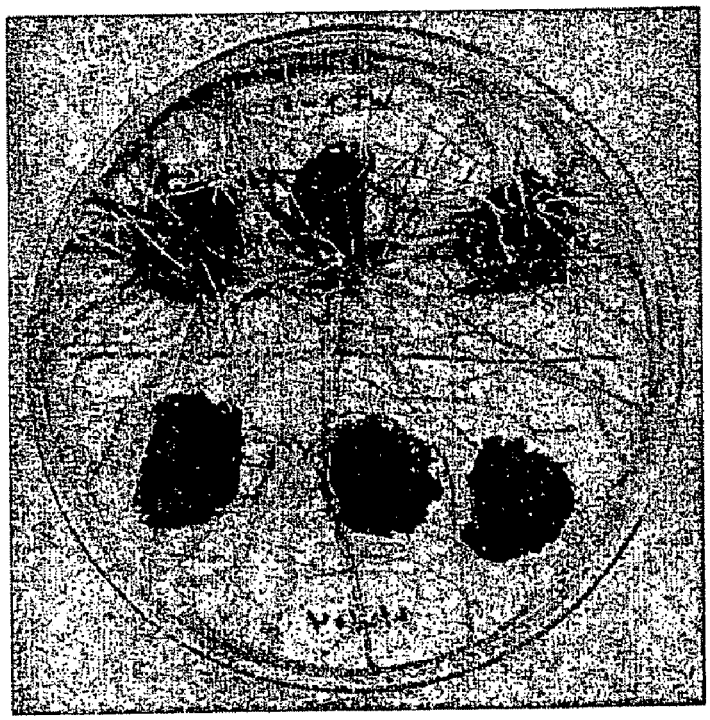
Fig. 7

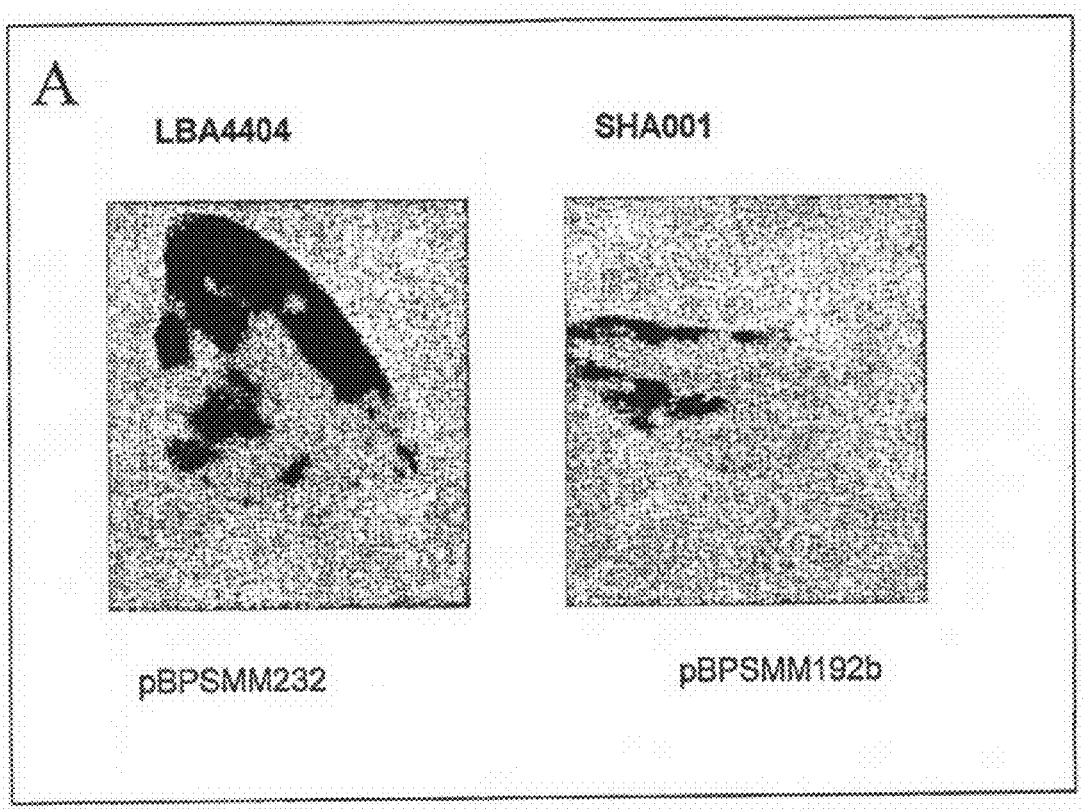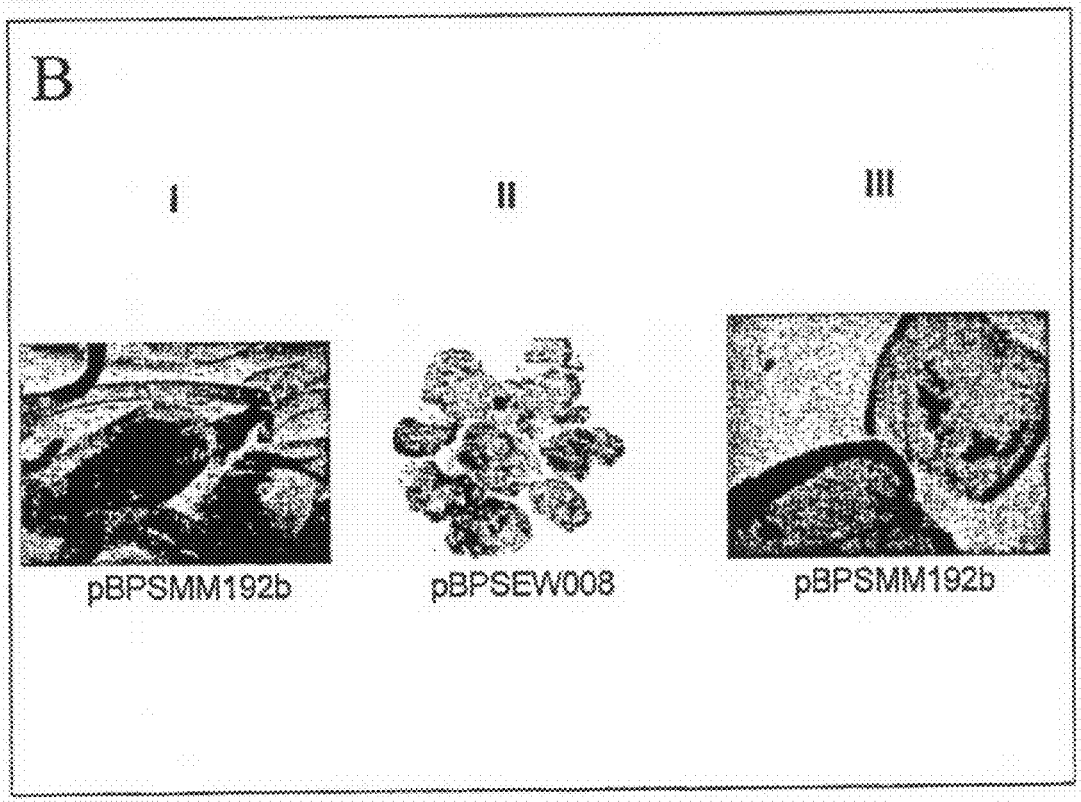
Fig. 8

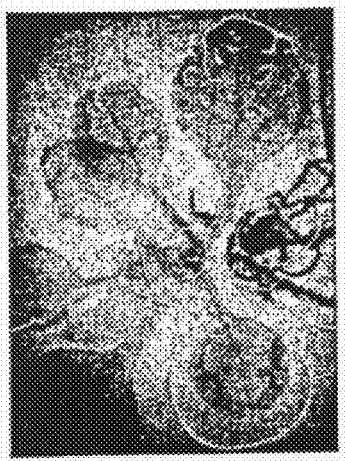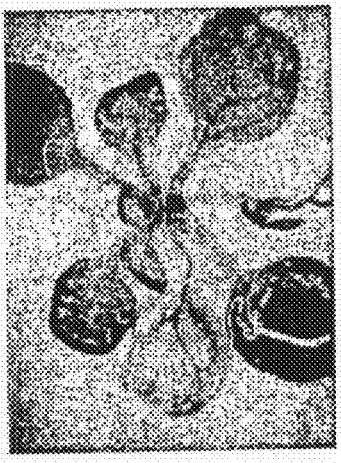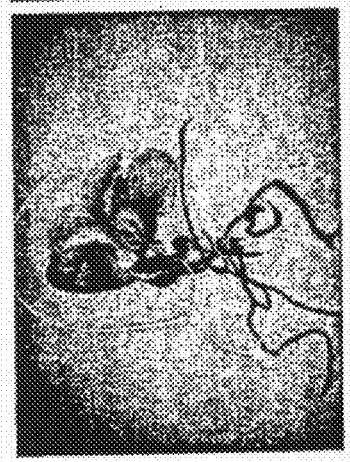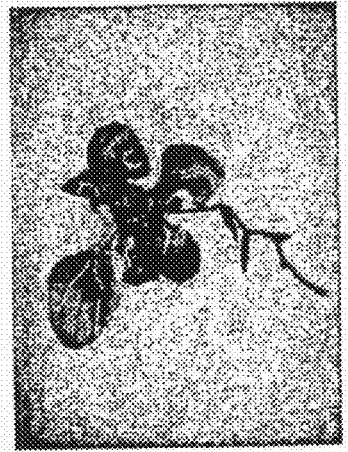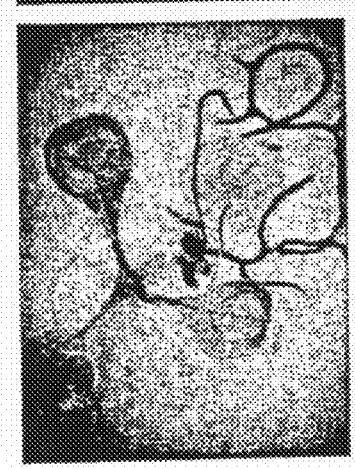
Fig. 10

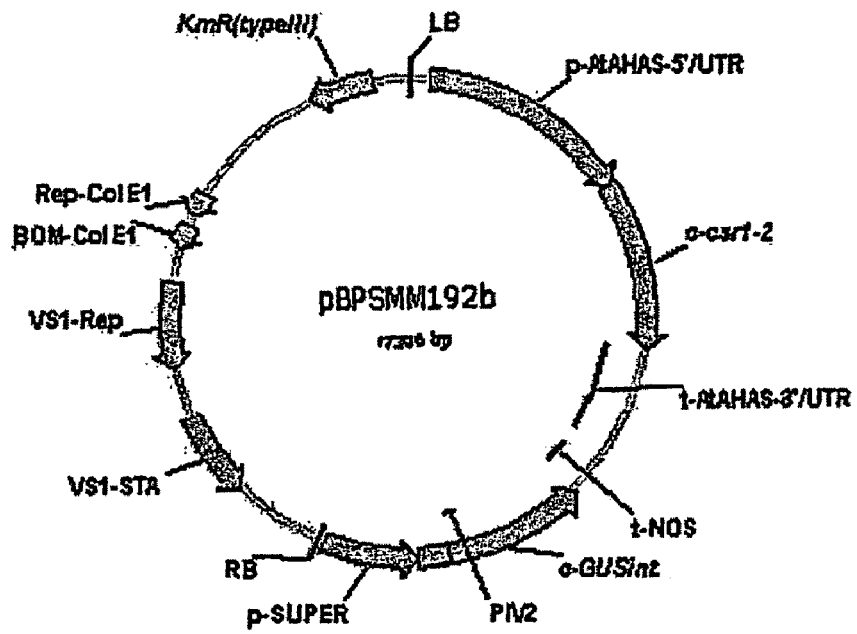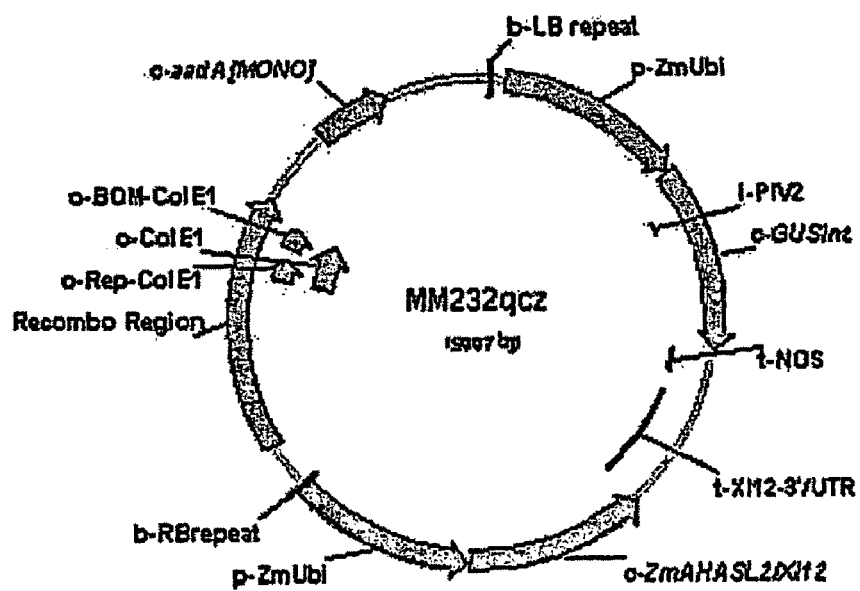
Fig. 13A

```
                      1                                                  M1          50
     K599_23S   AATGAGGGTT TGG..GTT.G AGACT|AATCG T......CGA TGCGAATTG|.
  AE008980#2   AGCGTGGGGT CGGTAGTTCG AGTCT|ACCCG GGCCCACCAT TGGTTTTTGA
  AE009348#2   AGCGTGGGGT CGGTAGTTCG AGTCT|ACCCG GGCCCACCAT TGGTTTTTGA
     AE008265   AGCGTGGGGT CGGTAGTTCG AGTCT|ACCCG GGCCCACCAT TGGTTTTTGA
  AE007948#2   AGCGTGGGGT CGGTAGTTCG AGTCT|ACCCG GGCCCACCAT TGGTTTTTGA
     AE009201   AGCGTGGGGT CGGTAGTTCG AGTCT|ACCCG GGCCCACCAT TGGTTTTTGA
        U45329   ....TGGGCG TTG.AGCTGG TGATT|GATTG G......TG TGGAAAATG|.
  AB102735#2   AATGAGGGTT TGG..GTT.G AGACT|GTTGG T......TGA TGCGAATTG|.

51                                                           100
     K599_23S   ..TTGCCGC. .GCCTGGTTG ATGA..GACC T.GGGTGATC GAGCTGGATG
  AE008980#2   ATTTGCCTGA TCCCTGGCGG TTAT..GCTG TCGGGTGTTT GCGATGGTTG
  AE009348#2   ATTTGCCTGA TCCCTGGCGG TTAT..GCTG TCGGGTGTTT GCGATGGTTG
     AE008265   ATTTGCCTGA TCCCTGGCGG TTAT..GCTG TCGGGTGTTT GCGATGGTTG
  AE007948#2   ATTTGCCTGA TCCCTGGCGG TTAT..GCTG TCGGGTGTTT GCGATGGTTG
     AE009201   ATTTGCCTGA TCCCTGGCGG TTAT..GCTG TCGGGTGTTT GCGATGGTTG
        U45329   ..TTGCCGA. ..GCTGAAGG TTTACGGATC TTCGGTGATC GAGCTGGATG
  AB102735#2   ..TTGCCGC. .GCCTGGTTG ATGA..GACC T.GGGTGATC GAGCTGGATG 101                                                          150
     K599_23S   GGGCTGTAGC TCAGCTGGGA GAGCACCTGC TTTGCAAGCA GGGGGTCAGC
  AE008980#2   GGGCTGTAGC TCAGCTGGGA GAGCACCTGC TTTGCAAGCA GGGGGTCAGC
  AE009348#2   GGGCTGTAGC TCAGCTGGGA GAGCACCTGC TTTGCAAGCA GGGGGTCAGC
     AE008265   GGGCTGTAGC TCAGCTGGGA GAGCACCTGC TTTGCAAGCA GGGGGTCAGC
  AE007948#2   GGGCTGTAGC TCAGCTGGGA GAGCACCTGC TTTGCAAGCA GGGGGTCAGC
     AE009201   GGGCTGTAGC TCAGCTGGGA GAGCACCTGC TTTGCAAGCA GGGGGTCAGC
        U45329   GGGCTGTAGC TCAGCTGGGA GAGCACCTGC TTTGCAAGCA GGGGGTCAGC
  AB102735#2   GGGCTGTAGC TCAGCTGGGA GAGCACCTGC TTTGCAAGCA GGGGGTCAGC

151                                          M2             200
     K599_23S   GGTTCGATCC CGCTCAGCTC CACCATTT|G. .......... ........TT
  AE008980#2   GGTTCGATCC CGCTCAGCTC CACCAATC|GC GGAACGCGAT TGGTGTGGTT
  AE009348#2   GGTTCGATCC CGCTCAGCTC CACCAATC|GC GGAACGCGAT TGGTGTGGTT
     AE008265   GGTTCGATCC CGCTCAGCTC CACCAATC|GC GGAACGCGAT TGGTGTGGTT
  AE007948#2   GGTTCGATCC CGCTCAGCTC CACCAATC|GC GGAACGCGAT TGGTGTGGTT
     AE009201   GGTTCGATCC CGCTCAGCTC CACCAATC|GC GGAACGCGAT TGGTGTGGTT
        U45329   GGTTCGATCC CGCTCAGCTC CACCATTT|AC ...A...... ..........
  AB102735#2   GGTTCGATCC CGCTCAGCTC CACCATTT|A. .......... .......T.

201                          M3                             250
     K599_23S   TTGTCCTGAC GCTGTCGCGA|TCTAACGATC GCTGCGCTCC GGA|CGGGCCG
  AE008980#2   ATGTGCTGAC GCTGTCGCGG|CTTTGC...C GCTGCGCTTC GCA|CGGGCCG
  AE009348#2   ATGTGCTGAC GCTGTCGCGG|CTTTGC...C GCTGCGCTCC GCA|CGGGCCG
     AE008265   ATGTGCTGAC GCTGTCGCGG|CTTTGC...C GCTGCGCTCC GCA|CGGGCCG
  AE007948#2   ATGTGCTGAC GCTGTCGCGG|CTTTGC...C GCTGCGCTTC GCA|CGGGCCG
     AE009201   ATGTGCTGAC GCTGTCGCGG|CTTTGC...C GCTGCGCTTC GCA|CGGGCCG
        U45329   CTGTCCTGAC GCTGTCGCAG|CTTACGC..T GCTGCGCTCC GGA|CGGGCCG
  AB102735#2   TTGCGCTCAC GGGTGAGCGG|TCCTTCGGAC .CTACCCTCC GCG|AGGGC.G

251    M4                           M5                     300
     K599_23S   |CGCCACGAGG CGCGACGGA|. CTATCGTCCT |TTATGGGCGA ATTGATCTGA|
  AE008980#2   |GCCAATGATG GCCGACGGC|T CGCTGAGCCT |GCATGGGTGA TCTGATCGGC|
  AE009348#2   |GCCAATGATG GCCGACGGC|. CTATCGGCCT |GTATGGGTGG ATTGATCGGT|
     AE008265   |GCCAATGATG GCCGACGGC|. CTATCGGCCT |GTATGGGTGG ATTGATCGGT|
  AE007948#2   |GCCAATGATG GCCGACGGC|T CGCTGAGCCT |GCATGGGTGA TCTGATCGGC|
     AE009201   |GCCAATGATG GCCGACGGC|T CGCTGAGCCT |GCATGGGTGA TCTGATCGGC|
        U45329   |CGGAACGATC CGCGTGGTC|. CTTTGGACCT |GTTTGGTGGC ATA...CGGA|
  AB102735#2   |CCGAACGATC GGCGACGCG|. CTATCGCGCT |GTACTGGAGA ATTGATCCGG|
```

Fig. 14A

```
              251                                                        300
    K599_23S  CGCCACGAGG CGCGACGGA. CTATCGTCCT TTATGGGCGA ATTGATCTGA
  AE008980#2  GCCAATGATG GCCGACGGCT CGCTGAGCCT GCATGGGTGA TCTGATCGGC
  AE009348#2  GCCAATGATG GCCGACGGC. CTATCGGCCT GTATGGGTGG ATTGATCGGT
    AE008265  GCCAATGATG GCCGACGGC. CTATCGGCCT GTATGGGTGG ATTGATCGGT
  AE007948#2  GCCAATGATG GCCGACGGCT CGCTGAGCCT GCATGGGTGA TCTGATCGGC
    AE009201  GCCAATGATG GCCGACGGCT CGCTGAGCCT GCATGGGTGA TCTGATCGGC
      U45329  CGGAACGATC CGCGTGGTC. CTTTGGACCT GTTTGGTGGC ATA...CGGA
  AB102735#2  CCGAACGATC GGCGACGCG. CTATCGCGCT GTACTGGAGA ATTGATCCGG 301                                                        350
    K599_23S  CGGC...... .......... .......... .......... ..........
  AE008980#2  AAGCAATACA GCGCGATAGC GCGTCGCCAA GAGTTTGGCG CCCTCACGGA
  AE009348#2  AAG....... .......... .......... .......... ..........
    AE008265  AAG....... .......... .......... .......... ..........
  AE007948#2  AAGCAATACA GCGCGATAGC GCGTCGCCAA GAGTTTGGCG CCCTCACGGA
    AE009201  AAGCAATACA GCGCGATAGC GCGTCGCCAA GAGTTTGGCG CCCTCACGGA
      U45329  ATT....... .......... .......... .......... ..........
  AB102735#2  CTGC...... .......... .......... .......... ..........

351                                                        400
    K599_23S  .......TG. ...C..G... ....AATTGT CTTCTGAAGA AATAA..AAG
  AE008980#2  GCGCCTTTGG CGCGTGAGTG CTGGAATATC CTTTTGAAGA AA.AA..ACG
  AE009348#2  .....TTTG. .......... .....ATATC CTTTTGAAGA AATAA..AAG
    AE008265  .....TTTG. .......... .....ATATC CTTTTGAAGA AATAA..AAG
  AE007948#2  GCGCCTTTGG CGCGTGAGTG CTGGAATATC CTTTTGAAGA AA.AA..ACG
    AE009201  GCGCCTTTGG CGCGTGAGTG CTGGAATATC CTTTTGAAGA AA.AA..ACG
      U45329  .......... .......... ......TTGT CTTCTGAAGA AAAAATAAGG
  AB102735#2  .......TG. ...C..G... ....AATTGT CTTCTGAAGA AATAA..AAG

401              M6                                        450
    K599_23S  TTTGCATCGT CCTGCTAAGG ATTGATGCCT GTTCTGAATA CATTGTGAAG
  AE008980#2  TTTGCATCAT TC.GC.AAGA ATTGATGCCT GTTCTGAATA CATTGTGAAG
  AE009348#2  TTTGCATCAT TC.GC.AAGA ATTGATGCCT GTTCTGAATA CATTGTGAAG
    AE008265  TTTGCATCAT TC.GC.AAGA ATTGATGCCT GTTCTGAATA CATTGTGAAG
  AE007948#2  TTTGCATCAT TC.GC.AAGA ATTGATGCCT GTTCTGAATA CATTGTGAAG
    AE009201  TTTGCATCAT TC.GC.AAGA ATTGATGCCT GTTCTGAATA CATTGTGAAG
      U45329  TTTGCACCGT TC..TTATGA AC.GGTGCCT GTTCTGG.TA CATTGTGAAG
  AB102735#2  TTTGCATCTT TT.GCTAAGA AA.GATGCCT GTTTTGGATA CATTGTGAAG 451                                                        500
    K599_23S  AGAAGATATG TCTGGAAGCG TCCAGGTGTT TTGGG...TT TAGGCCCGAG
  AE008980#2  AGAAGATATG TCTGGAAGCG TCCAGGTGTT TTGGG...TT TAGGCCCGAA
  AE009348#2  AGAAGATATG TCTGGAAGCG TCCAGGTGTT TTGGG...TT TAGGCCCGAA
    AE008265  AGAAGATATG TCTGGAAGCG TCCAGGTGTT TTGGG...TT TAGGCCCGAA
  AE007948#2  AGAAGATATG TCTGGAAGCG TCCAGGTGTT TTGGG...TT TAGGCCCGAA
    AE009201  AGAAGATATG TCTGGAAGCG TCCAGGTGTT TTGGG...TT TAGGCCCGAA
      U45329  AGAAGATTGA TCTGGAGGCT TCCAGGTATT GTGAG...GG AAACCTTGCG
  AB102735#2  AGAAGATATG TCTGGAAGCG TCCAGGTGTT TTGAGCCCTT GTGGTTTGAA

501              M7                                        550
    K599_23S  ACGTCCGAGA CCAGTCCTTG TGAAACCGTG TGATGGCTTA GTCGGCCGGA
  AE008980#2  ACGTCCGAGA CCAATCCCTG AGAAACCGTG TGATGGCTTA GTCGGCCGGA
  AE009348#2  ACGTCCGAGA CCAATCCCTG AGAAACCGTG TGATGGCTTA GTCGGCCGGA
    AE008265  ACGTCCGAGA CCAATCCCTG AGAAACCGTG TGATGGCTTA GTCGGCCGGA
  AE007948#2  ACGTCCGAGA CCAATCCCTG AGAAACCGTG TGATGGCTTA GTCGGCCGGA
    AE009201  ACGTCCGAGA CCAATCCCTG AGAAACCGTG TGATGGCTTA GTCGGCCGGA
      U45329  ATGTCCGAGC CCTTTCC.TG ATGATCCCTA GGATGGTCTA GCCGACCTGA
  AB102735#2  GCGTCCGAGC CCAGTCCCTG AGAAACCGTG TGATGGCTTA GTCGGCCGGA
```

Fig. 14B

```
                551                                      M8   600
   K599_23S  ATTGGTGGAG GGGTTGGAGG TAGGAAGGAT CGCTTGTCCT G..GGCATTT
 AE008980#2  ATTGGTGGAG GGGTTGGAGG TAGGAAGGAT CGCTTGTCCG A..GGCATTT
 AE009348#2  ATTGGTGGAG GGGTTGGAGG TAGGAAGGAT CGCTTGTCCG A..GGCATTT
    AE008265 ATTGGTGGAG GGGTTGGAGG TAGGAAGGAT CGCTTGTCCG A..GGCATTT
 AE007948#2  ATTGGTGGAG GGGTTGGAGG TAGGAAGGAT CGCTTGTCCG A..GGCATTT
    AE009201 ATTGGTGGAG GGGTTGGAGG TAGGAAGGAT CGCTTGTCCG A..GGCATTT
      U45329 CTTTGGTGAA GGATTGGAGG TAGGAAGGAA .GCTTGTCAC TCTGGATTGT
 AB102735#2  ATTGGTGGAG GGGTTGGAGG TAGGAAGGAT CGCTTGTCCG A..GGCATGT 601                                           650
   K599_23S  TTGTTGTTGG A.ACTTCG.G T..TCCTCTG ATGAAGATGC TGGATTGGTG
 AE008980#2  TTGTTGTTGG A.GCTTTAAG C..TCCTCTG ATGGGAATGC TGGATTGATG
 AE009348#2  TTGTTGTTGG A.GCTTTAAG C..TCCTCTG ATGGGAATGC TGGATTGATG
    AE008265 TTGTTGTTGG A.GCTTTAAG C..TCCTCTG ATGGGAATGC TGGATTGATG
 AE007948#2  TTGTTGTTGG A.GCTTTAAG C..TCCTCTG ATGGGAATGC TGGATTGATG
    AE009201 TTGTTGTTGG A.GCTTTAAG C..TCCTCTG ATGGGAATGC TGGATTGATG
      U45329 TCGTTGTTCA TCGTCTTTGA CGATG.TCTG ATGAACGATC .GGATTACCG
 AB102735#2  TTGTTGTTTG AAGGTTTAGG CCTTCATCTG ATGGACATGC TGGATTGATG 651                                           700
   K599_23S  TTGCCTGACC GCGCATCACC GGATGATATC TCGAGAAGCT GGTCTTAATG
 AE008980#2  TTGCCTGACC GCGCATCACC GGATGATATC TCGAGAAGCT GGTCTTAATG
 AE009348#2  TTGCCTGACC GCGCATCACC GGATGATATC TCGAGAAGCT GGTCTTAATG
    AE008265 TTGCCTGACC GCGCATCACC GGATGATATC TCGAGAAGCT GGTCTTAATG
 AE007948#2  TTGCCTGACC GCGCATCACC GGATGATATC TCGAGAAGCT GGTCTTAATG
    AE009201 TTGCCTGACC GCGCATCACC GGATGATATC TCGAGAAGCT GGTCTTAATG
      U45329 TTGCCTGACC GCACGGTACC GGATTGATC  TCGAGAAGCT GGTCTTAA.G
 AB102735#2  TTGCCTGACC GCGCATCACC GGATGATATC TCGAGAAGCT GGTCTTAATG

701  M9                              M10    750
   K599_23S  GTATGGCTTC GAGGTGCAC. ...CGGCGTG CCCTCAAA.G AAGAC.CGTA
 AE008980#2  ATACGACCTC GAAGTGCAC. ...CGGCGTG CCTTCAAA.G AGGAT.TGTA
 AE009348#2  ATACGACCTC GAAGTGCAC. ...CGGCGTG CCTTCAAA.G AGGAT.TGTA
    AE008265 ATACGACCTC GAAGTGCAC. ...CGGCGTG CCTTCAAA.G AGGAT.TGTA
 AE007948#2  ATACGACCTC GAAGTGCAC. ...CGGCGTG CCTTCAAA.G AGGAT.TGTA
    AE009201 ATACGACCTC GAAGTGCAC. ...CGGCGTG CCTTCAAA.G AGGAT.TGTA
      U45329 ATA.GACTGC .AAGTGAGCT GCTCGGCGTA GCTCCAATAA AGCAGATCTA
 AB102735#2  ATACGACCTC GAAGTGCAC. ...CGGCGTG CCTTCATATG AGGAT.TGTA 751                                           800
   K599_23S  CCGA.CACGT CGATGTCATC GTTGGT.GTT GCGGTTGTAA AAGGTAACCG
 AE008980#2  TCGAACACGT CGATGTCATC GTTGGT.GTT GCGGTTGTAA AAGGTAACCG
 AE009348#2  TCGAACACGT CGATGTCATC GTTGGT.GTT GCGGTTGTAA AAGGTAACCG
    AE008265 TCGAACACGT CGATGTCATC GTTGGT.GTT GCGGTTGTAA AAGGTAACCG
 AE007948#2  TCGAACACGT CGATGTCATC GTTGGT.GTT GCGGTTGTAA AAGGTAACCG
    AE009201 TCGAACACGT CGATGTCATC GTTGGT.GTT GCGGTTGTAA AAGGTAACCG
      U45329 TCGAACACGT CGATGGCATC ATGAC...GAA CCAATTGTAA AAGGTAATTG
 AB102735#2  TCGAACACGT CGATGTCATC GTGACTTGAT CTGGTTGTAA AAGGTAACCG 801                                           850
   K599_23S  TAACCGTTGT TCCTCTCTTT ATCGTTAGGG ATGGAATGGC TTTCGCGGCA
 AE008980#2  TAACCGTTGT TCCTCTCTTT ATCGTTAGAG ATGGAATGGC TTTCGCGGCA
 AE009348#2  TAACCGTTGT TCCTCTCTTT ATCGTTAGAG ATGGAATGGC TTTCGCGGCA
    AE008265 TAACCGTTGT TCCTCTCTTT ATCGTTAGAG ATGGAATGGC TTTCGCGGCA
 AE007948#2  TAACCGTTGT TCCTCTCTTT ATCGTTAGAG ATGGAATGGC TTTCGCGGCA
    AE009201 TAACCGTTGT TCCTCTCTTT ATCGTTAGAG ATGGAATGGC TTTCGCGGCA
      U45329 G.TTTTGGG  TC........ .......... ......TGGC ATATGCGGC.
 AB102735#2  GATCTGCCGG TCAT...... .TC....... ..........C TT........
```

Fig. 14C

```
               851                                                          900
   K599_23S    GATTGAGTTT TGCCCGGATG GCCCGATTTG GCACCCCTTT GAGCGCAAGC
   AE008980#2  GATTGAGTTT TGCCCGGATT GCCCGATTTG GCACCCCTTT GAGCGTAAGC
   AE009348#2  GATTGAGTTT TGCCCGGATG GCCCGATTTG GCACCCCTTT GAGCGTAAGC
     AE008265  GATTGAGTTT TGCCCGGATG GCCCGATTTG GCACCCCTTT GAGCGTAAGC
   AE007948#2  GATTGAGTTT TGCCCGGATT GCCCGATTTG GCACCCCTTT GAGCGTAAGC
     AE009201  GATTGAGTTT TGCCCGGATT GCCCGATTTG GCACCCCTTT GAGCGTAAGC
        U45329 ...T.....T .GTCCGTATG GTCAGGTTTG GAACCCCTTT GAGCGCAAGC
   AB102735#2  .......... ....CGGAAT GAC.GGCTT. .......... ..........

901                                                          950
   K599_23S    GAGAAGGAAA GGTTCTGCCA AATCCAACAG ATGATGAGCA TAGACAATGA
   AE008980#2  GAGAAGGAAA GGTTCTGCCA AATCCAACAG ATGATGAGCA TAGACAATGA
   AE009348#2  GAGAAGGAAA GGTTCTGCCA AATCCAACAG ATGATGAGCA TAGACAATGA
     AE008265  GAGAAGGAAA GGTTCTGCCA AATCCAACAG ATGATGAGCA TAGACAATGA
   AE007948#2  GAGAAGGAAA GGTTCTGCCA AATCCAACAG ATGATGAGCA TAGACAATGA
     AE009201  GAGAAGGAAA GGTTCTGCCA AATCCAACAG ATGATGAGCA TAGACAATGA
        U45329 GAGAAGGATA GGAATT.CCA AACCCAATAA ATGATGAGCA TTGGCAATGA
   AB102735#2  ..GA...... .......... .......... .TGATGAGCA TAGACAATGA 951                                                         1000
   K599_23S    GAACGAAGAA GT.GAATTAA GGGCATTTGG TGGATGCCTT GGCATGCACA
   AE008980#2  GAACGAAGAA GT.GAATTAA GGGCATTTGG TGGATGCCTT GGCATGCACA
   AE009348#2  GAACGAAGAA GT.GAATTAA GGGCATTTGG TGGATGCCTT GGCATGCACA
     AE008265  GAACGAAGAA GT.GAATTAA GGGCATTTGG TGGATGCCTT GGCATGCACA
   AE007948#2  GAACGAAGAA GT.GAATTAA GGGCATTTGG TGGATGCCTT GGCATGCACA
     AE009201  GAACGAAGAA GT.GAATTAA GGGCATTTGG TGGATGCCTT GGCATGCACA
        U45329 GAACGATTAA GTCGTCGTAA GGGCATTTGG TGGATGCCTT GGCATGCACA
   AB102735#2  GAACGAAGAA GT.GAATTAA GGGCATTTGG TGGATGCCTT GGCATGCACA 1001                                                        1050
   K599_23S    GGCGAAGAAG GACGTGATAC GCTGCGAAAA GCCGTGGGGA GCTGCGAATA
   AE008980#2  GGCGAAGAAG GACGTGATAC GCTGCGAAAA GCCGTGGGGA GCTGCGAATA
   AE009348#2  GGCGAAGAAG GACGTGATAC GCTGCGAAAA GCCGTGGGGA GCTGCGAATA
     AE008265  GGCGAAGAAG GACGTGATAC GCTGCGAAAA GCCGTGGGGA GCTGCGAATA
   AE007948#2  GGCGAAGAAG GACGTGATAC GCTGCGAAAA GCCGTGGGGA GCTGCGAATA
     AE009201  GGCGAAGAAG GACGTGATAC GCTGCGAAAA GCCGTGGGGA GCTGCGAATA
        U45329 GGCGATGAAG GACGTGATAC GCTGCGATAA GCCGTGGGGA GCTGCGAATG
   AB102735#2  GGCGAAGAAG GACGTGATAC GCTGCGAAAA GCCGTGGGGA GCTGCGAATA 1051                                                        1100
   K599_23S    AGCTTTGATC CATGGATCTC CGAATGGGGC AACCCACCTT AAATGCTTGG
   AE008980#2  AGCTTTGATC CATGGATCTC CGAATGGGGC AACCCACCTT AAATGCTTGG
   AE009348#2  AGCTTTGATC CATGGATCTC CGAATGGGGC AACCCACCTT AAATGCTTGG
     AE008265  AGCTTTGATC CATGGATCTC CGAATGGGGC AACCCACCTT AAATGCTTGG
   AE007948#2  AGCTTTGATC CATGGATCTC CGAATGGGGC AACCCACCTT AAATGCTTGG
     AE009201  AGCTTTGATC CATGGATCTC CGAATGGGGC AACCCACCTT AAATGCTTGG
        U45329 AGCTTTGATC CATGGATTTC CGAATGGGGA AACCCACCTT AAATGCTTAG
   AB102735#2  AGCTTTGATC CATGGATCTC CGAATGGGGC AACCCACCTT AAATGCTTGG 1101                                                        1150
   K599_23S    AAAATCCA.. .......... ....GTCTGT TT........ ..........
   AE008980#2  AAAATCCA.. .......... ....GTCTGT TT........ ..........
   AE009348#2  AAAATCCA.. .......... ....GTCTGT TT........ ..........
     AE008265  AAAATCCA.. .......... ....GTCTGT TT........ ..........
   AE007948#2  AAAATCCA.. .......... ....GTCTGT TT........ ..........
     AE009201  AAAATCCA.. .......... ....GTCTGT TT........ ..........
        U45329 AAAATCCA.. .......... ....AACTGT CAG....... ..........
   AB102735#2  GAAATCTGTT TTGTTGGCTG GATGGTCTGT TTGGGTTTAC CCATACAGGG
```

Fig. 14D

```
              1151                                                    1200
    K599_23S  ..........  ..........  ..........  ..........  ..........
 AE008980#2   ..........  ..........  ..........  ..........  ..........
 AE009348#2   ..........  ..........  ..........  ..........  ..........
    AE008265  ..........  ..........  ..........  ..........  ..........
 AE007948#2   ..........  ..........  ..........  ..........  ..........
    AE009201  ..........  ..........  ..........  ..........  ..........
      U45329  ..........  ..........  ..........  ..........  ..........
 AB102735#2   CGCTAGCCCG  TCGGTGCTTT  TGCACCGCGC  CGTCCGCAGG  CCTTTGGCCG 1201                                                    1250
    K599_23S  TAACGAACGG  CCTG....GG  TTTCCAAGCA  TTGTGA.TAA  GGTATCTTAC
 AE008980#2   TAACGAACGG  CCTG....GG  TTTCCAAGCA  TTATTA.TAA  GGTATCTTAC
 AE009348#2   TAACGAACGG  CCTG....GG  TTTCCAAGCA  TTATTA.TAA  GGTATCTTAC
    AE008265  TAACGAACGG  CCTG....GG  TTTCCAAGCA  TTATTA.TAA  GGTATCTTAC
 AE007948#2   TAACGAACGG  CCTG....GG  TTTCCAAGCA  TTATTA.TAA  GGTATCTTAC
    AE009201  TAACGAACGG  CCTG....GG  TTTCCAAGC.  ..........  ..........
      U45329  TGATGA.CGG  CTTG....GG  TTTCTAAGCA  TTGTTAATAA  GGTATCTTA.
 AB102735#2   TGAGGACAGA  ACTGAACAGG  TTTCCAAGCA  TTGTGA.TAA  GGTATCTTAC 1251                                                    1300
    K599_23S  TTTCGAATAC  ATAGGGGTAA  GAAGCGAACG  CAGGGAACTG  AAACATCTAA
 AE008980#2   TTTCGAATAC  ATAGGGGTAA  GAAGCGAACG  CAGGGAACTG  AAACATCTAA
 AE009348#2   TTTCGAATAC  ATAGGGGTAA  GAAGCGAACG  CAGGGAACTG  AAACATCTAA
    AE008265  TTTCGAATAC  ATAGGGGTAA  GAAGCGAACG  CAGGGAACTG  AAACATCTAA
 AE007948#2   TTTCGAATAC  ATAGGGGTAA  GAAGCGAACG  CAGGGAACTG  AAACATCTAA
    AE009201  ..........  ..........  ..........  ..........  ..........
      U45329  TCCTGAATAC  ATAGGGGTAA  GAAGCGAACT  CGGGAACTG   AAACATCTAA
 AB102735#2   TTTCGAATAC  ATAGGGGTAA  GAAGCGAACG  CAGGGAACTG  AAACATCTAA 1301                                                    1350
    K599_23S  GTACCTGCAG  GAAAGGACAT  CAACCGAGAC  TCCGCAAGTA  GTGGCGAGCG
 AE008980#2   GTACCTGCAG  GAAAGGACAT  CAACCGAGAC  TCCGTAAGTA  GTGGCGAGCG
 AE009348#2   GTACCTGCAG  GAAAGGACAT  CAACCGAGAC  TCCGTAAGTA  GTGGCGAGCG
    AE008265  GTACCTGCAG  GAAAGGACAT  CAACCGAGAC  TCCGTAAGTA  GTGGCGAGCG
 AE007948#2   GTACCTGCAG  GAAAGGACAT  CAACCGAGAC  TCCGTAAGTA  GTGGCGAGCG
    AE009201  ..........  ..........  ..........  ..........  ..........
      U45329  GTACCCGAAG  GAAAGGACAT  CAACCGAGAC  TCCGTAAGTA  GTGGCGAGCG
 AB102735#2   GTACCTGCAG  GAAAGGACAT  CAACCGAGAC  TCCGCAAGTA  GTGGCGAGCG 1351                                         1393
    K599_23S  AACGCGGACC  AGGCCAGTGG  CAATGATGAA  TAAAGCGGAA  CGA
 AE008980#2   AACGCGGACC  AGGCCAGTGG  CAATGATGAA  TAAAGCGGAA  CGA
 AE009348#2   AACGCGGACC  AGGCCAGTGG  CAATGATGAA  TAAAGCGGAA  CGA
    AE008265  AACGCGGACC  AGGCCAGTGG  CAATGATGAA  TAAAGCGGAA  CGA
 AE007948#2   AACGCGGACC  AGGCCAGTGG  CAATGATGAA  TAAAGCGGAA  CGA
    AE009201  ..........  ..........  ..........  ..........  ...
      U45329  AACACGGACC  AGGCCAGTGG  CAATGAGGAA  TAAAGCGGAA  CAA
 AB102735#2   AACGCGGACC  AGGCCAGTGG  CAATGATGAA  TAAAGCGGAA  CGA
```

DISARMED *AGROBACTERIUM* STRAINS, RI-PLASMIDS, AND METHODS OF TRANSFORMATION BASED THEREON

RELATED APLICATIONS

This application is a national stage application (under 35 U.S.C. 371) of PCT/EP2005/009366 filed on Aug. 31, 2005, which claims the benefit of U.S. Provisional application 60/606,789 filed Sep. 2, 2004.

FIELD OF THE INVENTION

The present invention relates "disarmed" strain variants of *Agrobacterium* strain K599 (NCPPB 2659), "disarmed" plasmid variants of the Ri-plasmid pRi2659, and derivatives thereof, and methods employing these strains and plasmids in plant transformation.

BACKGROUND OF THE INVENTION

The genus *Agrobacterium* (for a recent review see Gelvin 2003) has been divided into a number of species. However, this division has been reflected, for the most part, disease symptomology and host range. *A. radiobacter* is an "avirulent" species, *A. tumefaciens* causes crown gall disease, *A. rhizogenes* causes hairy root disease, *A. rubi* causes cane gall disease, and *A. vitis* causes galls on grape and a few other plant species (Otten 1984; Smith and Townsend 1907; Hildebrand 1934; for review on *A. rhizogenes* see Nilsson and Olsson, 1997). Although Bergey's Manual of Systematic Bacteriology still reflects this nomenclature, classification is complex and confusing. The disease symptomology is largely due to the transfer, integration, and expression in the plant cell genome of DNA (T-DNA) originating from large plasmids called Ti (tumor inducing) and Ri (root inducing) plasmids (Van Laerebeke 1974; Chilton 1977, 1982; Moore 1979; White 1982; Tepfer 1983; Nester 1984). Curing a particular plasmid and replacing this plasmid with another type of tumorigenic plasmid can alter disease symptoms. For example, infection of plants with *A. tumefaciens* C58, containing the nopaline-type Ti plasmid pTiC58, results in the formation of crown gall teratomas. When this plasmid is cured, the strain becomes nonpathogenic. Introduction of Ri plasmids into the cured strain "converts" the bacterium into a rhizogenic strain (Lam 1984, White 1980). Furthermore, one can introduce a Ti (tumor-inducing) plasmid from *A. tumefaciens* into *A. rhizogenes*; the resulting strain incites tumors of altered morphology on Kalanchoe plants (Costantino 1980). Thus, because *A. tumefaciens* can be "converted" into *A. rhizogenes* simply by substituting one type of oncogenic plasmid for another, the term "species" becomes meaningless. Thus, in recent years the method to distinguish the bacteria strains by their crown gall or hairy root phenotype does not seem to be appropriate anymore, since these features are only linked to the extrachromosomal plasmid. Genomic DNA analysis revealed that some strains formerly classified as *A. rhizogenes* are more related to *A. tumefaciens* and vice versa.

A more meaningful classification system divides the genus *Agrobacterium* into "biovars" based on growth and metabolic characteristics (Keane 1970). Using this system, most *A. tumefaciens* and *A. rubi* (Tighe 2000) strains belong to biovar I, *A. rhizogenes* strains fit into biovar II, and biovar III is represented by *A. vitis* strains. More recently, yet another taxonomic classification system for the genus *Agrobacterium* has been proposed (Young 2001). The recent completion of the DNA sequence of the entire *A. tumefaciens* C58 genome (which is composed of a linear and a circular chromosome, a Ti plasmid, and another large plasmid (Goodner 1999, 2001; Wirawan 1996) may provide a starting point for reclassification of *Agrobacterium* "strains" into true "species." A recent classification based on RAPD (random amplified polymorphic DNA) reflects the genomic differences and is providing a "family" tree for several *Agrobacterium* strains (Llop 2003). A modified classification scheme was proposed by Sawada (Sawada 1993).

Although the genetic background of Agrobacteria is little explored, extensive knowledge already exists about the functionality of their Ti or Ri-plasmids in plant infection. Mobilization of the T-DNA requires that the products of genes located elsewhere on the Ti or Ri plasmid, called collectively the vir genes, which are activated by certain elicitors from the wounded plant cells in trans to synthesize and transfer a single-stranded copy of the T-DNA (the T-strand) to the plant cell (Zambryski 1992; Zupan 1995). The T-DNA sequence on the Ti plasmid is flanked by short 24-bp direct repeats (Yadav 1982), which are required for the recognition of the T-DNA (Wang 1984). Sequences immediately surrounding these borders appear to be involved in the polarity of T-strand synthesis, which initiates at the right border (Wang 1987). Foreign DNA flanked by T-DNA border sequences can be transferred into plant cells using *A. tumefaciens* as the vector (Hernalsteens 1980). Inactivation or removal of the native T-DNA genes involved in hormone synthesis would render the *A. tumefaciens* incapable of producing the crown gall disease symptoms. This process of inactivating or removing genes responsible for disease symptoms is termed "disarming." The first methods of *A. tumefaciens* engineering involved the simultaneous disarming and introduction of the desired gene, since the introduced gene directly replaced the genes in the T-DNA By a method termed "homogenotization" (Matzke and Chilton, 1981), the native T-DNA of the Ti plasmid was replaced with a desired gene for transformation. Another strategy developed for engineering *A. tumefaciens* involved cloning the desired gene into a cointegrative intermediate vector, which contained a single region of T-DNA homology and a single border sequence. In this system, the sequences are recombined by a single-crossover event (Horsch 1985), which results in the entire vector, including the gene of interest, being integrated. Cointegrative systems pair in regions of homology between the T-DNA region of the Ti plasmid and the DNA sequence on the introduced integrative vector. One example of a useful cointegrative plasmid is pGV3850, a Ti plasmid from a nopaline strain (C58), from which the entire T-DNA region between the borders was replaced with pBR322, thus offering a recombination site for any gene construct containing pBR322 homology (Zambryski 1983).

Upon the discovery that T-DNA does not have to be on the same plasmid as the vir genes (de Framond 1983; Hoekema 1983, 1985), the binary vector was developed. A binary vector is maintained in the *A. tumefaciens* separate from the Ti plasmid, and contains the gene of interest and a plant selectable marker gene between T-DNA border sequences. These vectors offer a great degree of flexibility, since they do not require a specifically engineered Ti plasmid with a homologous recombination site. For that reason, any disarmed *A. tumefaciens* strain can be used to transfer genes for any binary vector. Owing to their versatility, binary vectors are currently the preferred intermediate vectors for cloning genes destined for *Agrobacterium*-mediated transformation in plants. However, any *A. tumefaciens* strain to be used with binary vectors must have its own Ti plasmid disarmed, especially if the target plant species is inefficiently transformed via *A. tumefaciens*. Otherwise, the desired gene from the binary vector will be co-transformed with the oncogenic phytohormone genes from the native T-DNA of the bacteria, thereby reducing transformation efficiency of the desired gene and also producing the tumorigenic disease symptoms in many of the target cells and thereby preventing the differentiation of these cells into normal plants.

Disarming wild-type *A. tumefaciens* strains for general use with binary vectors has involved, in some cases, a form of homogenotization. An intermediate construct containing a marker gene flanked by Ti plasmid sequences that are homologous to regions that lie outside the T-DNA, is introduced into the wild-type *A. tumefaciens* by bacterial conjugation (Hood 1986, 1993). Whereas disarmed *A. tumefaciens* strains typically have their entire T-DNA sequences removed, it has also been demonstrated that T-DNA mobilization can be inactivated by removal of the right border sequence: reports from work with nopaline-type strains of *A. tumefaciens* show that the right border of T-DNA is necessary for gene transfer, whereas the left border is not (Joos 1983; Peralto and Ream 985; Shaw 1984; Wang 1984). *Agrobacterium tumefaciens* has a diverse dicot host range, and additionally some monocot families (De Cleene 1976; Smith 1995). There are several different strains of *A. tumefaciens*, each classified into octopine-type, nopaline-type, and L,L-succinamopine-type, named after type of opine synthesized in the plant cells they infect. These strains have comparable, although not identical, host ranges and disarmed versions of many types of *A. tumefaciens* have been used successfully for gene transfer into a variety of plant species (van Wordragen 1992; Hood 1993).

*Agrobacterium rhizogenes* strains are classified the same way *A. tumefaciens* strains are. Typically, they are classified by the opine they produce. The most common strains are agropine-type strains (e.g., characterized by the Ri-plasmid pRi A4), mannopine-type strains (e.g., characterized by the Ri-plasmid pRi8196) and cucumopine-type strains (e.g., characterized by the Ri-plasmid pRi2659). Some other strains are of the mikimopine-type (e.g., characterized by the Ri-plasmid pRi1724). Mikimopine and cucumopine are stereo isomers but no homology was found between them on the nucleotide level (Suzuki 2001).

Soybean (*Glycine max* L. Merr.) has proven to be very difficult to transform with *A. tumefaciens*, at least in part because it is refractory to infection by wild-type *A. tumefaciens*. Comparative studies with a number of soybean cultivars and *A. tumefaciens* strains suggest that soybean susceptibility to *A. tumefaciens* is limited, and is both cultivar- and bacterial strain dependent (Bush 1991; Byrne 1987; Hood 1987). The problems with soybean recalcitrance to *A. tumefaciens* are further complicated by the difficulty of working with soybean in tissue culture. Despite some advances to date, however, *Agrobacterium*-mediated transformation in soybean remains inefficient and labor-intensive, and methods for improving that efficiency are continually being sought.

As mentioned earlier, some *A. tumefaciens* strains infect soybean more readily than others. One strain, A281, is a supervirulent, broad host-range, L,L-succinamopine-type *A. tumefaciens* with a nopaline-type C58 chromosomal background, containing the L,L-succinamopine-type Ti plasmid, pTiBo542 (Hood 1987). Disarming this strain has produced EHA101 and EHA105, strains now widely used in conjunction with soybean transformation (Hood 1986, 1987). Various other disarmed *Agrobacterium* strains are described (A208, U.S. Pat. No. 5,416,011; LBA 4404, WO 94/02620). Hood et al., (1993) disclose the disarming of three Ti plasmids: one each of the octopine, nopaline and L,L-succinamopine types. *Agrobacterium tumefaciens* strains A281 and EHA101 are disclosed as able to transform soybean. The disarming derivative of plasmid pTiBo542 from strain A281 is disclosed and designated pEHA105.

*Agrobacterium rhizogenes* Ri-transformed plants of several plant species have a characteristic phenotype, with shortened internodes, wrinkled leaves, and an abundant root mass with extensive lateral branching (Tepfer 1984). The rol genes in Ri T-DNA induce changes in sensitivity to plant hormones and/or in the metabolism of plant hormones (Maurel 1994; Moritz and Schmülling 1998; Nilsson 1997; Shen 1988). Furthermore, transformation of plant tissues by infection with *A. rhizogenes* increases the production of certain metabolites (Ermayanti 1994; Mano 1986; Sim 1994).

Native, "armed" *Agrobacterium rhizogenes* K599 (pRi2659) is capable to induce hairy root formation in a variety of soybean cultivars including Jack, Williams 82, Cartter, Fayette, Hartwig, Mandarin, Lee 68, Peking, and PI437654 (Cho 2000).

In the case of *A. rhizogenes*, the mannopine Ri plasmid of strain 8196 possesses a single T-region which does not share homology with any of the pTi T-DNA oncogenes (Lahners 1984). This observation suggests that a novel mechanism, different from that due to tms expression in tmr Ti mutants, is responsible for root induction by this strain. In the case of the agropine strains such as A4, two distinct regions of the Ri plasmid are transferred to the plant genome: the TL-region and the TR-region (Huffman 1984; Jouanin 1984; White 1985). The size of the TL-DNA encountered in plants transformed by strain A4 is quite constant, while the length of the TR-DNA is more variable. Hybridizations with the T-regions of *A. tumefaciens* revealed homology in the pRi TR-region with genes of the TR-DNA of octopine Ti plasmids that are involved in agropine synthesis. Amongst the common pTi oncogenes, homology was found only with the fm loci (Willmitzer 1982; Huffman 1984; Jouanin 1984), suggesting a possible role for TR-DNA directed auxin synthesis in root induction, even if the tms-like genes are not found in the genome of all regenerated transformed plants (Taylor 1985; Jouanin 1986a). The TL region, in contrast, does not hybridize with genes of pTi T-DNA (Jouanin 1984). The TL-DNA sequence established by Slightom et al. (1986) confirms this absence of homology at the nucleotide level. However, the TL-DNA is highly homologous to the single T-region of the mannopine pRi8196 and might therefore be capable of inducing transformed roots.

Vilaine et al. (Vilaine 1987) have demonstrated that the transfer of TL-DNA alone, as well as the transfer of TR-DNA alone, does lead to root induction on infected plant fragments, suggesting the existence of two independent molecular mechanisms for root induction on agropine type Ri plasmids. Vilaine et al. are further describing disarming the agropine-type *Agrobacterium rhizogenes* A4RS strain by deleting the TL, TR, or both the TL and TR regions from the Ri-plasmid pRiA4 resulting in *A. rhizogenes* strain RS (pRiB278b). Described is conjugation of the disarmed Ri plasmids with cosmids carrying the TL or TR region thereby "rescuing" the hairy root phenotype. No use for gene transfer of said disarmed *A. rhizogenes* strain is disclosed.

While *Agrobacterium tumefaciens* mediated plant transformation has become a standard in the plant biotech industry for many plants species, use of *Agrobacterium rhizogenes* is only rarely made. To date, only native "armed" *Agrobacterium rhizogenes* strains were employed to incorporate foreign genes into plants (e.g., Narayanan 1999; Kouchi 1999). Since *A. rhizogenes* can also transfer the T-DNA of binary vectors 'in trans', the Ri plasmid has been used as a vector for the introduction of foreign DNA into dicotyledonous plant species (Bevan 1984; Simpson 1986; Hamill 1991). However, the *Agrobacterium rhizogenes* strains employed in these disclosures are "armed" (by comprising their native Ri plasmids) and are still able to cause the hairy root phenotype (see e.g., Narayanan 1999).

Although some of the problems linked to the plant transformation have been overcome by the methods described in the art, there is still a significant need for improvement and alternative procedure. Although significant advances have been made in the field of *Agrobacterium*-mediated transformation methods, a need continues to exist for improved methods to facilitate the ease, speed and efficiency of such methods, especially also for transformation of monocotyledonous plants and dicotyledonous plants which are recalcitrance to transformation with standard *A. tumefaciens* strains. Therefore, it was the objective of the present invention to provide an alternative method which offers an improved transformation efficiency for a broad variety of plant species. This objective is solved by the present invention.

SUMMARY OF THE INVENTION

This invention uses "disarmed" strain variants of *Agrobacterium* strain K599 (NCPPB 2659) for T-DNA delivery into plants cells. Hereinafter the previous classification as an "*A. rhizogenes*" strain is not employed, because beside the hairy root inducing phenotype (which is a result of the Ri plasmid but not the bacterial genome) the strain seems to be only remotely related to other *A. rhizogenes* strains based on a comparison analysis of ribosomal rDNA sequences. Thus, the strain is considered to be a unique specimen neither being unambiguously an *A. tumefaciens* or *A. rhizogenes* type of strain.

A first embodiment of the invention relates to a method for producing a transgenic plant cell comprising the steps of.
a) providing bacteria of a transgenic, non-pathogenic strain variant of *Agrobacterium* strain K599 (NCPPB 2659) or of a derivative of said strain, wherein said strain variant is capable to infect plant cells but is lacking hairy root phenotype inducing properties and wherein said strain variant is further comprising a transgenic T-DNA, and
b) co-cultivating a plant cell with said bacteria, and
c) isolating or selecting plant cells comprising stably integrated into their genome said transgenic T-DNA.

Another embodiment of the invention relates to a method for producing a transgenic plant comprising the steps of:
a) providing bacteria of a transgenic, non-pathogenic strain variant of *Agrobacterium* strain K599 (NCPPB 2659) or of a derivative of said strain, wherein said strain variant is capable to infect plant cells but is lacking hairy root phenotype inducing properties and wherein said strain variant is further comprising a transgenic T-DNA, and
b) co-cultivating a plant, plant cell or plant tissue with said bacteria, and
c) isolating or selecting and—optionally—regenerating plants comprising stably integrated into their genome said transgenic T-DNA.

The methods of the invention can be used to transform virtually all kind of plants, preferably plant cell, plant tissue, or plant derived from a plant selected from the group of monocotyledonous plants, dicotyledonous plants, and gymnosperm plants. More preferably the plant is from a genus selected from the group consisting of *Medicago, Lycopersicon, Brassica, Cucumis, Solanum, Juglans, Gossypium, Malus, Vitis, Antirrhinum, Populus, Fragaria, Arabidopsis, Picea, Capsicum, Chenopodium, Dendranthema, Pharbitis, Pinus, Pisum, Oryza, Zea, Titicum, Triticale, Secale, Lolium, Hordeum, Glycine, Pseudotsuga, Kalanchoe, Beta, Helianthus* and *Nicotiana*.

In a preferred embodiment of the invention the transgenic T-DNA comprises at least one plant expressible selectable marker gene.

Another embodiment of the invention is related to a non-pathogenic strain variant of *Agrobacterium* strain K599 (NCPPB 2659) or of a derivative of said strain (hereinafter "disarmed" strain variant), wherein said strain variant is capable to infect plant cells but is lacking hairy root phenotype inducing properties. Another embodiment of the invention is related to a transgenic, non-pathogenic strain variant of *Agrobacterium* strain K599 (NCPPB 2659) or of a derivative of said strain, wherein said strain variant is capable to infect plant cells but is lacking hairy root phenotype inducing properties and wherein said strain variant is further comprising a transgenic T-DNA.

In a preferred embodiment of the invention, said non-pathogenic strain variant of *Agrobacterium* strain K599 (NCPPB 2659) (or of a derivative of said strain) is capable to infect plant cells, to mediate T-DNA transfer into plant cells, and to mediate T-DNA insertion into the plant genome, but is lacking the hairy root phenotype inducing properties. More preferably, this is achieved by presence of a non-pathogenic plasmid variant of the Ri-plasmid pRi2659 (the natural Ri-plasmid in *Agrobacterium* strain K599; NCPPB 2659) or a derivative thereof. Said non-pathogenic plasmid variant preferably provides all functions required for plant cell infection and transformation but is lacking sequences causing the hairy root phenotype.

The derivative of *Agrobacterium* strain K599 (NCPPB2659) is preferably a soil borne, plant pathogenic bacterium, characterized by a 16S-23S rRNA intergenic sequence comprising at least one sequence motif selected from the group consisting of sequence motifs described by SEQ ID NO: 5, 6, 7, 8, 9, 10, 11, 12, 13, and 14. The non-pathogenic strain variant may further comprise one or more characteristics selected from the group consisting of presence of mutant or chimeric virA or virG genes or presence of super-virulent plasmids. The non-pathogenic strain variant of *Agrobacterium* strain K599 (NCPPB2659) may comprise a non-pathogenic plasmid variant of the pRI2659 plasmid (as defined below).

Yet another embodiment of the invention is related to a non-pathogenic plasmid variant of pRi2659 (the natural Ri-plasmid in *Agrobacterium* strain K599; NCPPB 2659) or a derivative thereof, said plasmid variant providing the functions required for plant cell infection and transformation, but lacking sequences causing the hairy root phenotype (hereinafter "disarmed" plasmid variant). Preferably—especially when used in combination with a transgenic T-DNA comprised in a separate (binary) vector—said "disarmed" plasmid variant is comprising no elements (such as for example T-DNA elements) which can be transferred into the plant genome. There are various means to provide such a "disarmed" plasmid variant. This may be realized by rendering the borders of the T-DNA dysfunctional (e.g., by mutagenesis) or—preferably—by deleting the entire T-DNA from the Ri plasmid.

In one especially preferred embodiment of the invention said non-pathogenic plasmid variant is comprising at least one sequence selected from the group of sequences described by
a) sequences comprising a sequence described by SEQ ID NO:25, or a sequence of at least 100 consecutive nucleotides of the sequence described by SEQ ID NO: 24, and b) sequences having a sequence identity of at least 90% to a sequence as described by SEQ ID NO: 24 or a sequence of at least 1000 consecutive nucleotides of the sequence described by SEQ ID NO: 24, and, c) sequences hybridizing under conditions equivalent to binding or hybridization at 68° C. in a solution consisting of 5× SSPE, 1% SDS, 5× Denhardt's reagent and 100 μg/mL denatured salmon sperm DNA followed by washing in a solution comprising 0.1× SSPE, and 0.1% SDS at 68° C. to a probe consisting of at least 100 consecutive nucleotides of a sequences as described by SEQ ID NO: 24 or the complementary sequence thereto.

The isolated sequence of the disarmed version of plasmid pRi2659 is provided herein. Thus, a preferred embodiment of the invention relates to an isolated nucleotide sequence selected from the group of sequences described by a) sequences comprising a sequence described by SEQ ID NO: 24, or a sequence of at least 100 consecutive nucleotides of the sequence described by SEQ ID NO: 24, and b) sequences having a sequence identity of at least 90% to a sequence as described by SEQ ID NO: 24 or a sequence of at least 1000 consecutive nucleotides of the sequence described by SEQ ID NO: 24, and, c) sequences hybridizing under conditions equivalent to binding or hybridization at 68° C. in a solution consisting of 5× SSPE, 1% SDS, 5× Denhardt's reagent and 100 μg/mL denatured salmon sperm DNA followed by washing in a solution comprising 0.1× SSPE, and 0.1% SDS at 68° C. to a probe consisting of at least 100 consecutive nucleotides of a sequences as described by SEQ ID NO: 24 or the complementary sequence thereto.

More preferably, said non-pathogenic plasmid variant is described by a nucleotide sequence describing the disarmed pRi2659 plasmid or a derivative above (as defined above). Even more preferably or alternatively, the derivative is encoding a virD2 protein having an amino acid sequence identify of at least 85% with the sequence described by SEQ ID NO 112. Said virD2 protein is expected to be a key factor for the enhanced performance in transformation of the disarmed pRi2659 plasmid. Thus another embodiment of the invention relates to a polypeptide comprising an amino acid sequence selected from the group consisting of:

a) the sequence as described by SEQ ID NO: 112 or sequences of at least 200 consecutive amino acids there of, b) sequences having an sequence identity of at least 85% (preferably at least 90% or 92%, more preferably at least 95% or 98%, most preferably at least 99%) with the sequences described by SEQ ID NO: 112.

However, also the other proteins encoded by the disarmed pRi2659 plasmid are considered to be useful for optimization of transformation processes, thus another embodiment of the invention relates to a polypeptide comprising an amino acid sequence selected from the group consisting of:

a) the sequence as described by any of SEQ ID NO: 25, 26, 27, 28, 29, 30, 31, 32, 33, 34, 35, 36, 37, 38, 39, 40, 41, 42, 43, 44, 45, 46, 47, 48, 49, 50, 51, 52, 53, 54, 55, 56, 57, 58, 59, 60, 61, 62, 63, 64, 65, 66, 67, 68, 69, 70, 71, 72, 73, 74, 75, 76, 77, 78, 79, 80, 81, 82, 83, 84, 85, 86, 87, 88, 89, 90, 91, 92, 93, 94, 95, 96, 97, 98, 99, 100, 101, 102, 103, 104, 114, 115, 116, 117, 118, 119, 120, 121, 122, 123, 124, 126, 128, 129, 130, 131, 132, 133, 134, 136, 137, 139, 140, 142, 143, 144, 145, 146, 147, 148, 149, 150, 151, 152, 154, 155, 156, 158, 159, 161, 162, 163, 164, 165, 166, 167, 168, 169, 170, 171, 172, 173, 174, 175, 176, 177, 178, 179, 180, 181, 182, 183, 184, 185, 186, or 187 or sequences of at least 200 consecutive amino acids (preferably at least 300 consecutive amino acids, more preferably at least 400 consecutive amino acids, preferably all consecutive amino acids) thereof, b) sequences having an sequence identity of at least 85% (preferably at least 90% or 92%, more preferably at least 95% or 98%, most preferably at least 99%) with a sequence described by any of SEQ ID NO: 25, 26, 27, 28, 29, 30, 31, 32, 33, 34, 35, 36, 37, 38, 39, 40, 41, 42, 43, 44, 45, 46, 47, 48, 49, 50, 51, 52, 53, 54, 55, 56, 57, 58, 59, 60, 61, 62, 63, 64, 65, 66, 67, 68, 69, 70, 71, 72, 73, 74, 75, 76, 77, 78, 79, 80, 81, 82, 83, 84, 85, 86, 87, 88, 89, 90, 91, 92, 93, 94, 95, 96, 97, 98, 99, 100, 101, 102, 103, 104, 114, 115, 116, 117, 118, 119, 120, 121, 122, 123, 124, 126, 128, 129, 130, 131, 132, 133, 134, 136, 137, 139, 140, 142, 143, 144, 145, 146, 147, 148, 149, 150, 151, 152, 154, 155, 156, 158, 159, 161, 162, 163, 164, 165, 166, 167, 168, 169, 170, 171, 172, 173, 174, 175, 176, 177, 178, 179, 180, 181, 182, 183, 184, 185, 186, or 187.

Still another embodiment of the invention relates to isolated nucleic acid sequences encoding said polypeptides. These sequences may be the isolated natural sequences (as comprised in the pRi2659 plasmid) or other sequences derived based on the degeneration of the genetic code.

Accordingly, a preferred embodiment of the invention relates to a non-pathogenic plasmid variant of pRi2659 or a derivative thereof, wherein said plasmid variant is comprising the sequences required for plant cell infection and transformation of the native, pathogenic pRi2659 or its derivative but is lacking the T-DNA, preferably the region described by the sequence from about base 538 to about base 15519 of the sequence characterized by GenBank Acc.-No. AJ271050 (SEQ ID NO: 4) or from about base 3644 to about 18577 base of the sequence characterized by SEQ ID NO: 26. This sequence corresponds to the T-DNA of the original, pathogenic Ri-plasmid pRi2659 as provided in the pathogenic *Agrobacterium* strain K599 (NCPPB 2659). More preferably said non-pathogenic plasmid variant is a sequence hybridizing under high-stringency conditions (e.g., equivalent to binding or hybridization at 68° C. in a solution consisting of 5× SSPE, 1% SDS, 5× Denhardt's reagent and 100 μg/mL denatured salmon sperm DNA followed by washing in a solution comprising 0.1× SSPE, and 0.1% SDS at 68° C.) with the original, pathogenic Ri-plasmid pRi2659 as provided in the pathogenic *Agrobacterium* strain K599 (NCPPB 2659), but not hybridizing under high-stringency conditions with the sequence from about base 538 to about base 15519 of the sequence characterized by GenBank Acc.-No. AJ271050 (SEQ ID NO: 4) or from about base 3644 to about 18577 base of the sequence characterized by SEQ ID NO: 26.

More preferably, the derivative of pRi2659 is a plasmid able to mediate T-DNA transfer from a soil borne bacterium into a plant cell further characterized by a) having a homology of at least 90% with the DNA encoding the native pRi2659 plasmid (as comprised in *Agrobacterium* strain K599 (NCPPB2659) or b) hybridizing under high stringency conditions equivalent to binding or hybridization at 68° C. in a solution consisting of 5× SSPE, 1% SDS, 5× Denhardt's reagent and 100 μg/mL denatured salmon sperm DNA followed by washing in a solution comprising 0.1× SSPE, and 0.1% SDS at 68° C. with the native pRi2659 plasmid.

Preferably, the T-DNA in said transgenic, non-pathogenic strain variant of *Agrobacterium* strain K599 (NCPPB 2659) or its derivative is comprised on a binary vector plasmid separate from the plasmid providing the features required for plant infection (such as an Ti- or Ri-plasmid lacking their neoplastic or hairy-root inducing properties). Preferably the T-DNA is flanked by at least the right border sequence (more preferably by the right and the left border sequence). Preferred are Ti- and/or Ri borders. In a preferred embodiment said transgenic T-DNA is comprising at least one expression cassette for conferring to said plant an agronomically valuable trait. In another preferred embodiment said T-DNA is further comprising at least one marker gene, which allows for selection and/or identification of transformed plants, plant cells or tissues.

The T-DNA borders of plasmid pRI2659 has been demonstrated to be especially efficient in T-DNA transfer and thus in generating transgenic plants (especially transgenic soybean plants). Thus another embodiment of the invention is related A transgenic T-DNA flanked by at least one T-DNA border from the *Agrobacterium rhizogenes* pRi2659 plasmid, said transgenic T-DNA comprising no sequences causing a hairy root phenotype. Preferably at least one of said border sequences is described by SEQ ID NO: 18 or 19. More preferably said transgenic T-DNA comprises at least one expression cassette for conferring to said plant an agronomically valuable trait or at least one marker gene, which allows for selection and/or identification of transformed plants, plant cells or tissues. Another subject of the invention relates to a transgenic vector comprising said transgenic T-DNA of the invention.

Other embodiments of the invention relate to cells or non-human organisms comprising a nucleotide sequence, a non-pathogenic plasmid variant, or a transgenic T-DNA of the invention. Preferably, said cells or non-human organisms ere selected from the group consisting of bacteria, yeasts, plants, mammals, and insects. In one preferred embodiment said cell or organism is a soil born bacterium of the genus *Rhizobiaceae*. In another preferred embodiment said cell or organism is plant cell or plant organism, more preferably selected from the group of monocotyledonous and dicotyledonous plants.

Other objects, advantages, and features of the present invention will become apparent from the following specification.

| Species | Accession # | Alternative name/ Name on dendrogram (if different from GenBank Acc.-No.) |
|---|---|---|
| A. tumefaciens | AB114201 | |
| A. tumefaciens | AF388033 | Strain 52 |
| A. tumefaciens | AF388030 | Strain 42 |
| A. tumefaciens | AY306228 | NCPPB 4042 |
| A. tumefaciens | AY306224 | CSL 3276 |

-continued

| Species | Accession # | Alternative name/ Name on dendrogram (if different from GenBank Acc.-No.) |
|---|---|---|
| A. tumefaciens | AY306223 | CSL 3139 |
| A. tumefaciens | AY306222 | |
| A. tumefaciens | D14500 | |
| A. tumefaciens | AJ389902 | NCPPB 1641 |
| A. tumefaciens | AJ012209 | C58 |
| A. tumefaciens | S56774 | C58 |
| A. tumefaciens | AB102735 | |
| A. tumefaciens | AB102734 | |
| A. tumefaciens | AB102733 | |
| A. tumefaciens | AB102732 | |
| A. spp. | AY174112 | JS71 |
| A. spp. | D14506 | |
| A. spp. | D14504 | |
| A. rhizogenes | D14501 | |
| A. rhizogenes | X67232 | |
| A. rhizogenes | X67224 | |
| A. vitis | D14502 | |
| A. vitis | D12795 | |
| A. vitis | X67225 | |
| R. vitis | AB118158 | |
| R. vitis | AB114418 | |
| A. vitis | AJ389912 | |
| A. vitis | AJ389911 | |
| A. rubi | D14503 | |
| A. rubi | X67228 | |
| A. rubi | D12787 | |
| A. larrymoorei | Z30542 | *Ficus* straim |
| R. leguminosarum | D14513 | |
| R. galegae | D11343 | |
| S. meliloti | D14509 | |
| S. fredii | D14516 | |
| R. tropici | D11344 | |
| A. rhizogenes | K599 | BPS 599 |
| A. tumefaciens | AGL0 | BPS 600 |
| A. tumefaciens | AGL1 | BPS 601 |
| A. tumefaciens | MP90 | BPS 602 |
| A. tumefaciens | LBA4404 | BPS 603 |

FIG. 1C Dendrogram demonstrating relationship of *Agrobacterium* strains as determined by virD2 amino acid sequence comparison. Sequences are compiled using Clustal W program (Saitou 1987). Strains are described by the GenBank Acc.-No. of their respective virD2 proteins. The following strains are assessed:

| Species | Accession # | Alternative name/ Name on dendrogram (if different from GenBank Acc.-No.) |
|---|---|---|
| Agrobacterium K599 | | Ri2659 = K599 |
| A. tumefaciens | AAL57024 | TiAB2/73 |
| A. tumefaciens | AD3250 | |
| A. tumefaciens | B25063 | TiA6 |
| A. tumefaciens | B37763 | TiC58 |
| A. rhizogenes | CAA31351 | A4b |
| A. tumefaciens | NP 053396 | TiSAKURA |
| A. tumefaciens | NP 059814 | Ti15955 |
| A. rhizogenes | NP 066749 | Ri1724 |
| A. tumefaciens | NP 396503 | TiC58 Cereon |
| A. tumefaciens | NP 536300 | TiC58 UW |
| Bradyrhizobium japonicum USDA 110 | NP 766684 | |
| Bordetella bronchiseptica RB50 | NP 887044 | |
| A. rhizogenes | P13462 | RiA4 |
| Streptococcus pneumoniae TIGR4 | ZP 00402780 | |
| Bordetella bronchiseptica RB50 | ZP 00613251 | |
| Azotobacter vinelandii OP | ZP 00416447 | |

Figure 2:
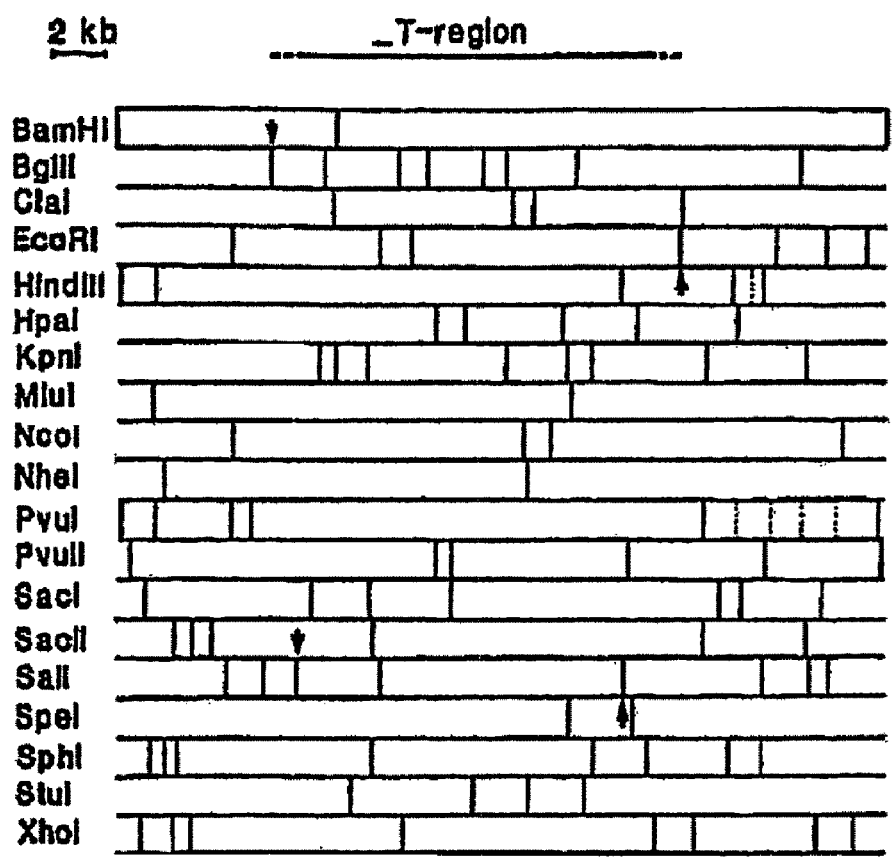

FIG. 2: Physical restriction map of T-DNA region of *Agrobacterium* plasmid pRi2659. The arrows indicate the right and left border regions (from: Combard 1987).

FIG. 3 Transient GUS expression in soybean (5 days) of leaf axillary meristem explants after 2 days co-cultivation with either AGL1 (pBPSMM192b) (I) or SHA016 (pBPSMM192b) (II). SHA016/pBPSMM192b is a disarmed, transgenic *Agrobacterium* K599 variant strain. AGL1/pBPSMM192b is a control strain. *Agrobacterium* strains SHA001 and SHA016 are functionally equivalent strains of *Agrobacterium* strain K599 (NCPPB 2659) (pRi2659Δtet), i.e. comprising the disarmed pRi2659Δtet plasmid.

Figure 4:
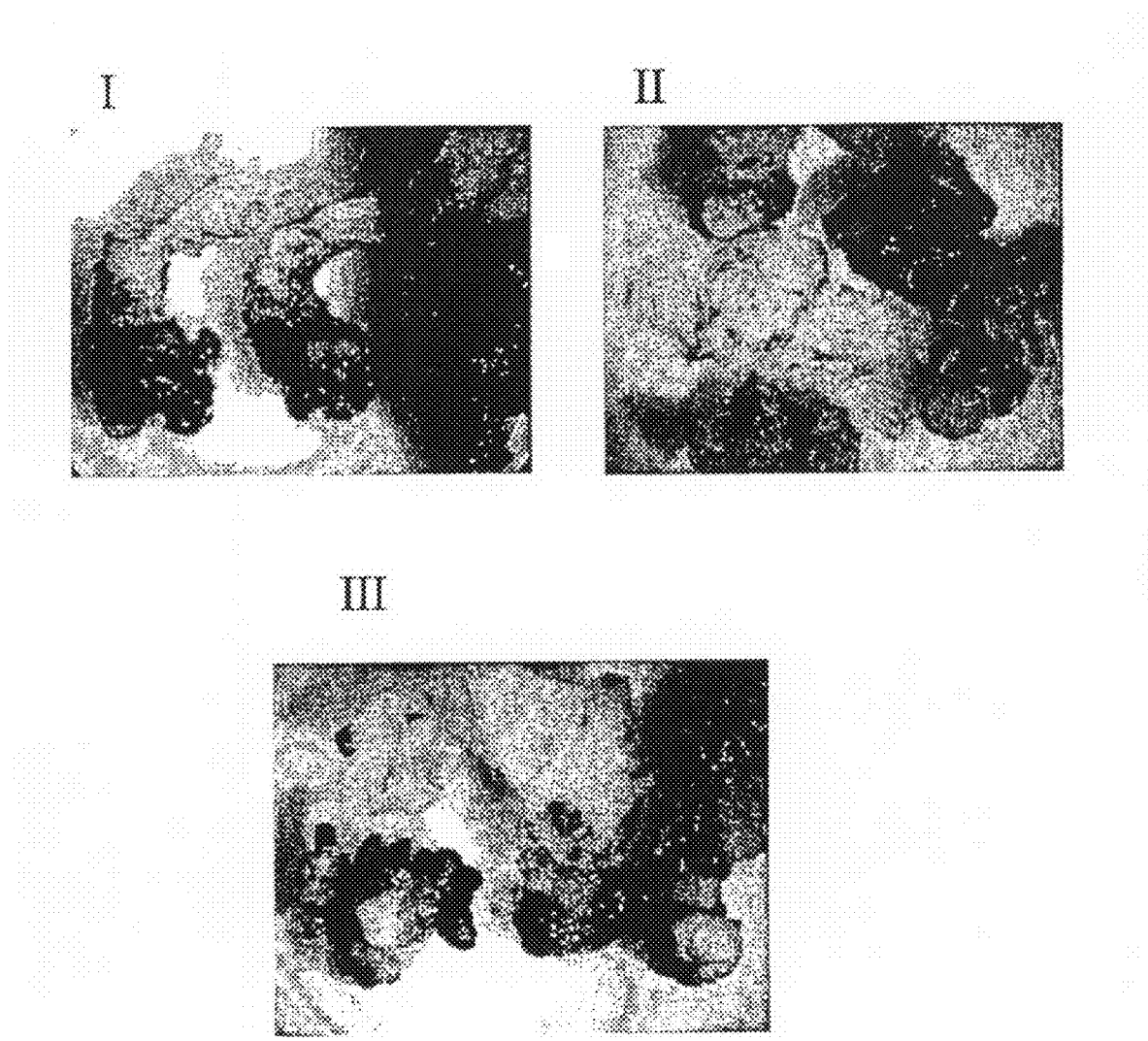

FIG. 4 Stable GUS expression in soybean 35 days post-infection using leaf axillary meristem explants infected with *Agrobacterium* SHA001 (pBPSEW008) (I, II, III: examples for various explants). SHA001 (pBPSEW008) is a disarmed, transgenic *Agrobacterium* K599 variant strain (pRi2659Δtet).

Figure 5:
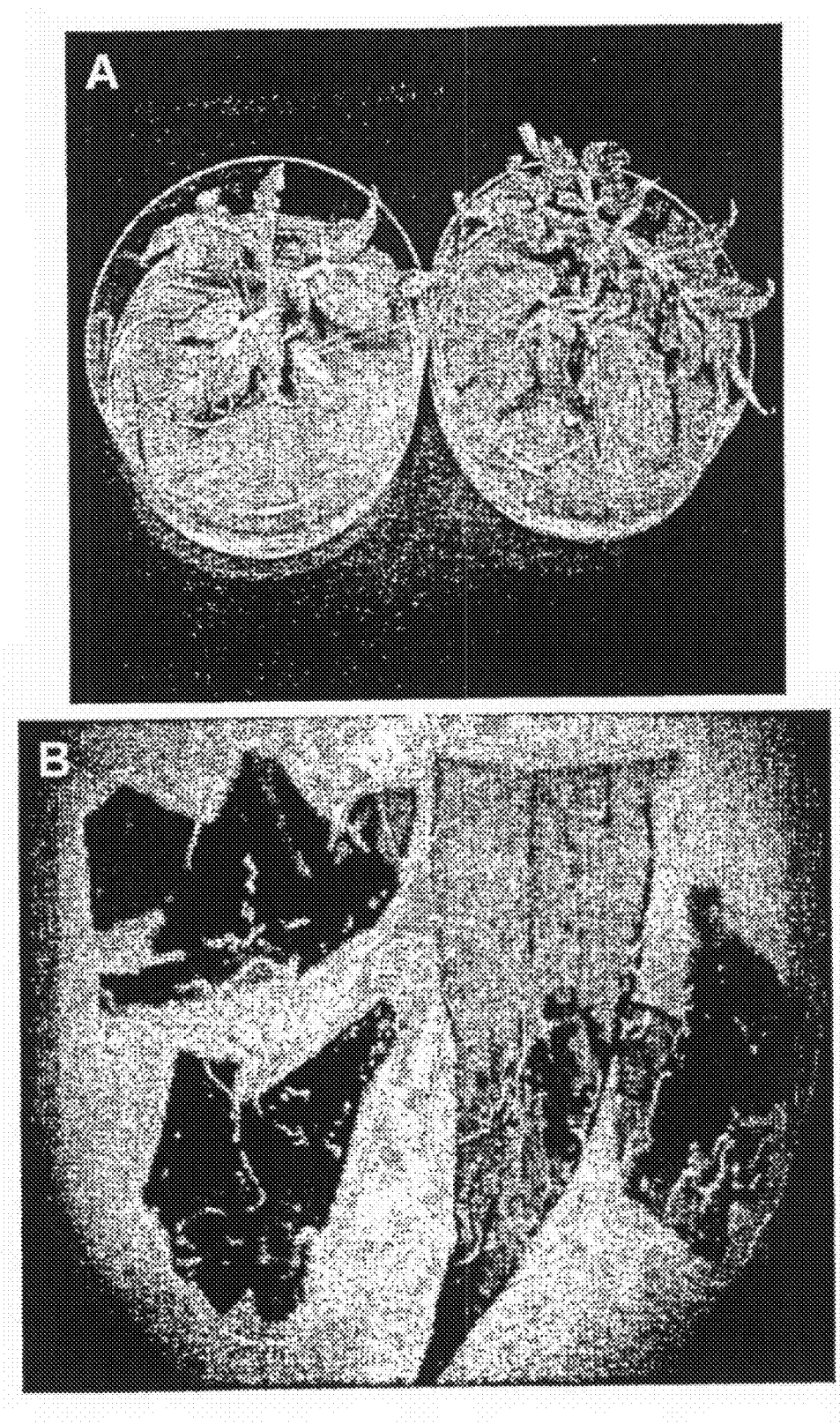

FIG. 5 Transgenic tomato plantlets (A) using recombinant SHA001 containing pBPSMM192b and GUS expression in the transgenic leaves (B). SHA001 (pBPSMM192b) is a disarmed, transgenic *Agrobacterium* K599 variant strain (pRi2659Δtet).

Figure 6:
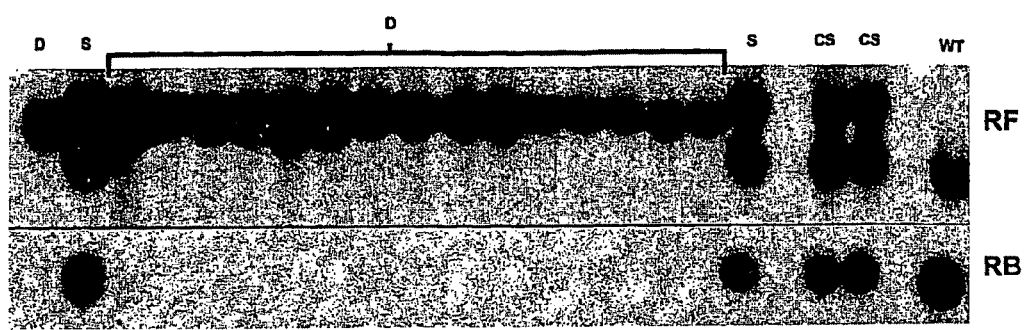

FIG. 6 Southern hybridization of disarmed tetracycline marked K599 (pRi2659Δtet). The loss of a hybridizing band in double cross over events, when probed with right border indicates the deletion of the T-DNA region from pRi2659 (lower Southern). Hybridizing band in upper Southern indicates the presence of flanking DNA outside the T-DNA deletion.

RF=hybridization with right flank probe
RB=hybridization with left flank probe
WT=wild type
S=clone resulting from single cross over recombination resulting in an insertion comprising both wild-type T-DNA and deletion-T-DNA
CS=confirmed single; clone resulting from single cross over with band pattern matching calculated band size (intermediate product)
D=clone resulting from double cross over recombination resulting in the intended T-DNA deletion (intended end product)

FIG. 7 Hairy Root Assay on Soybean Cotyledons
[a] Infection with disarmed K599 does not cause hairy roots.
[b] Infection with wild type K599 causes hairy roots.

Figure 9:
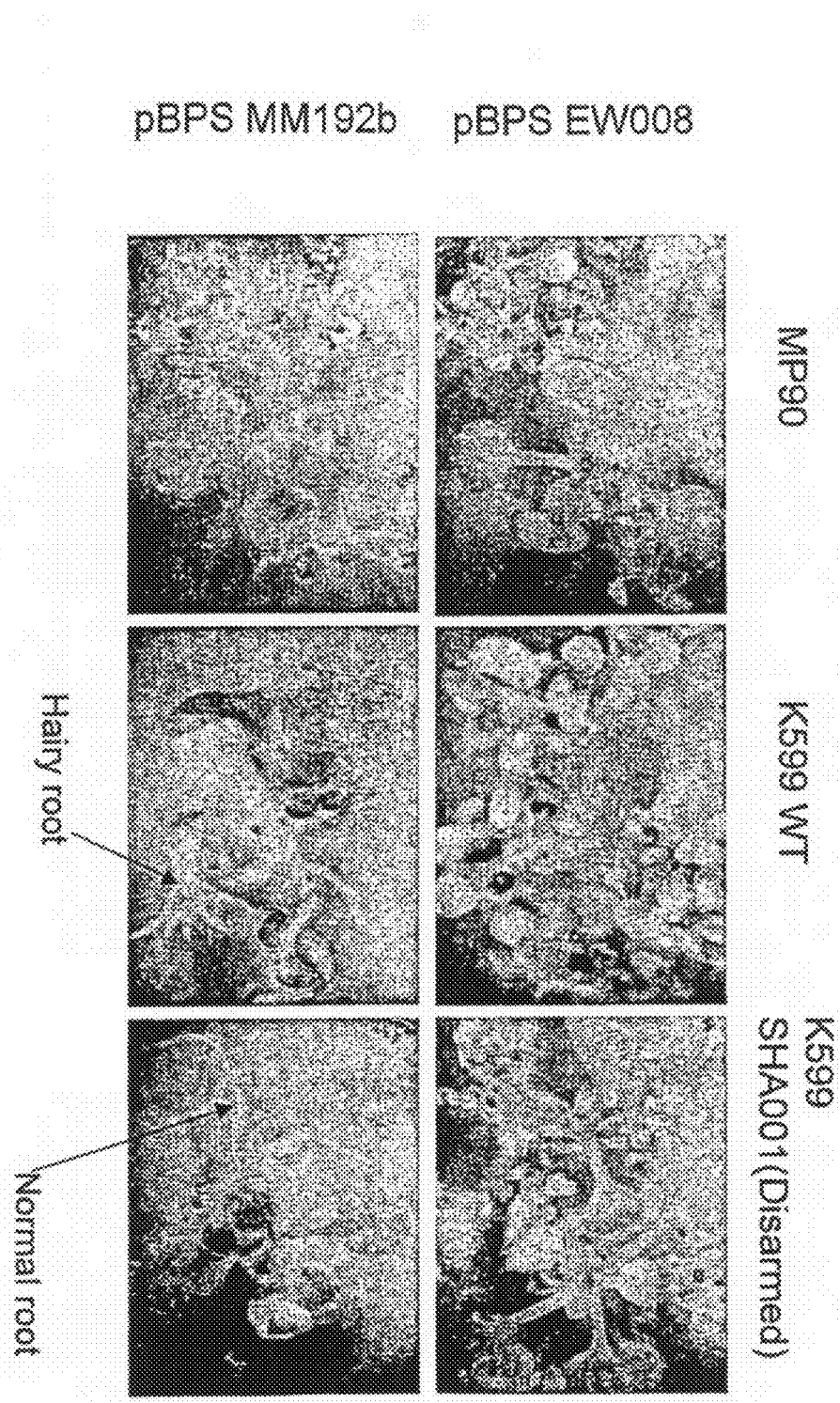

FIG. 8 Transient GUS Expression in plant cells (for construct description see examples below).
A: Maize Embryo transformation. SHA001 is a disarmed *Agrobacterium* K599 variant strain. LBA4404 is a control strain.
B: Transformation of other plant tissues with SHA001 in combination with various binary vectors (indicated below the figures; description see examples).
I: Soybean Axillary Nodes on Seedlings; II: Soybean Organogenic Callus; III: Tomato Cotyledons FIG. 9: Stable T1 transgenic *Arabidopsis* selected with AHAS. Transformation was carried out with *Agrobacterium* strains MP90 (control strain 1), wild-type *Agrobacterium* strain K599 (control strain 2), and disarmed *Agrobacterium* strain K599 (SHA001), each comprising either binary plasmid pBPSEW008 or pBPSMM192b, respectively.

FIG. 10: GUS staining of stable T1 transgenic *Arabidopsis*. Stable T1 transgenic *Arabidopsis* selected with AHAS. Transformation was carried out with *Agrobacterium* strains MP90 (control strain 1), wild-type *Agrobacterium* strain K599 (control strain 2), and disarmed *Agrobacterium* strain K599 (SHA001), each comprising either binary plasmid pBPSEW008 or pBPSMM192b, respectively.

Figure 11:
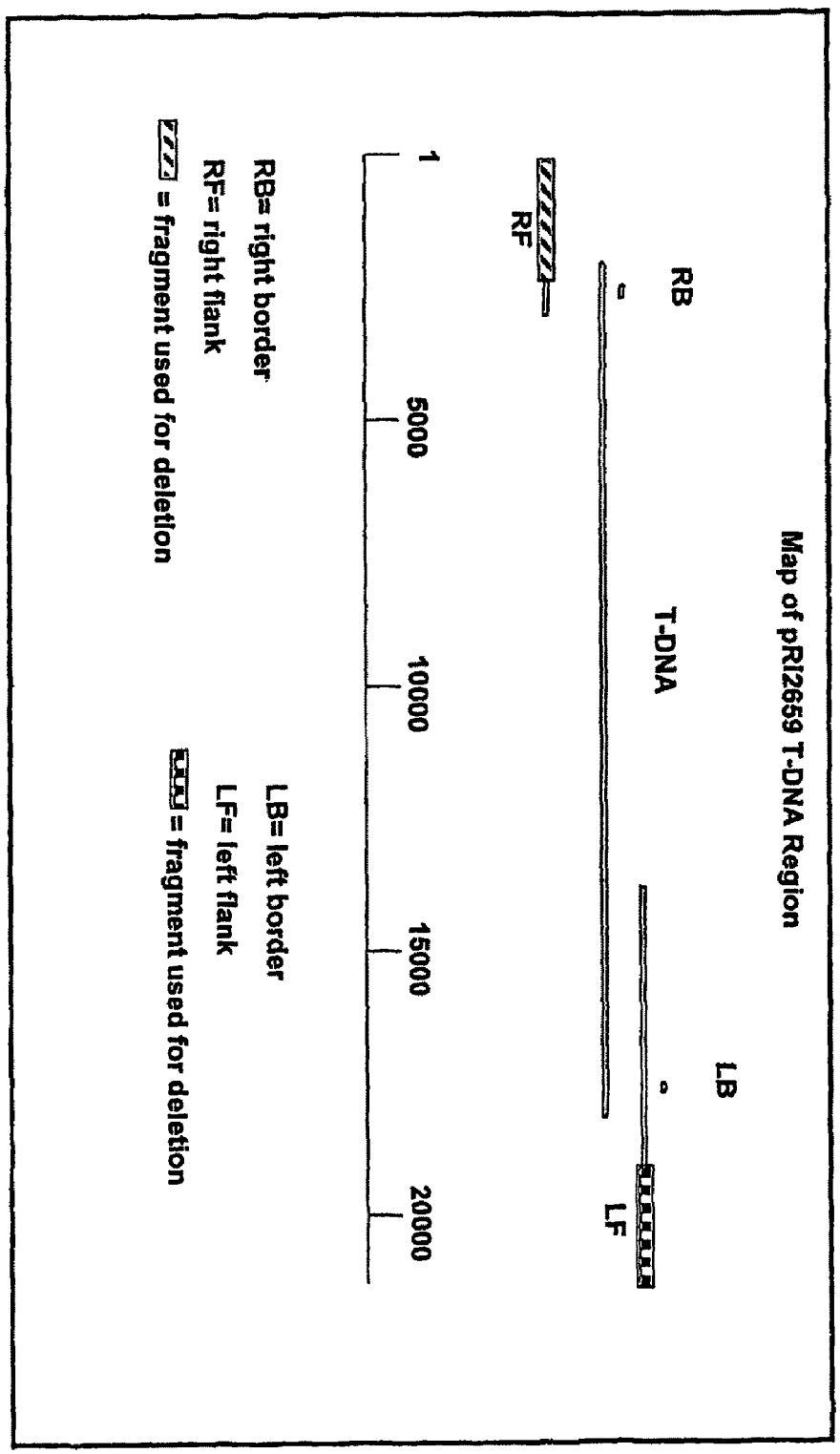

FIG. 11: Map of plasmid pRi2659 T-DNA region including right and left flanking regions.

Figure 12:
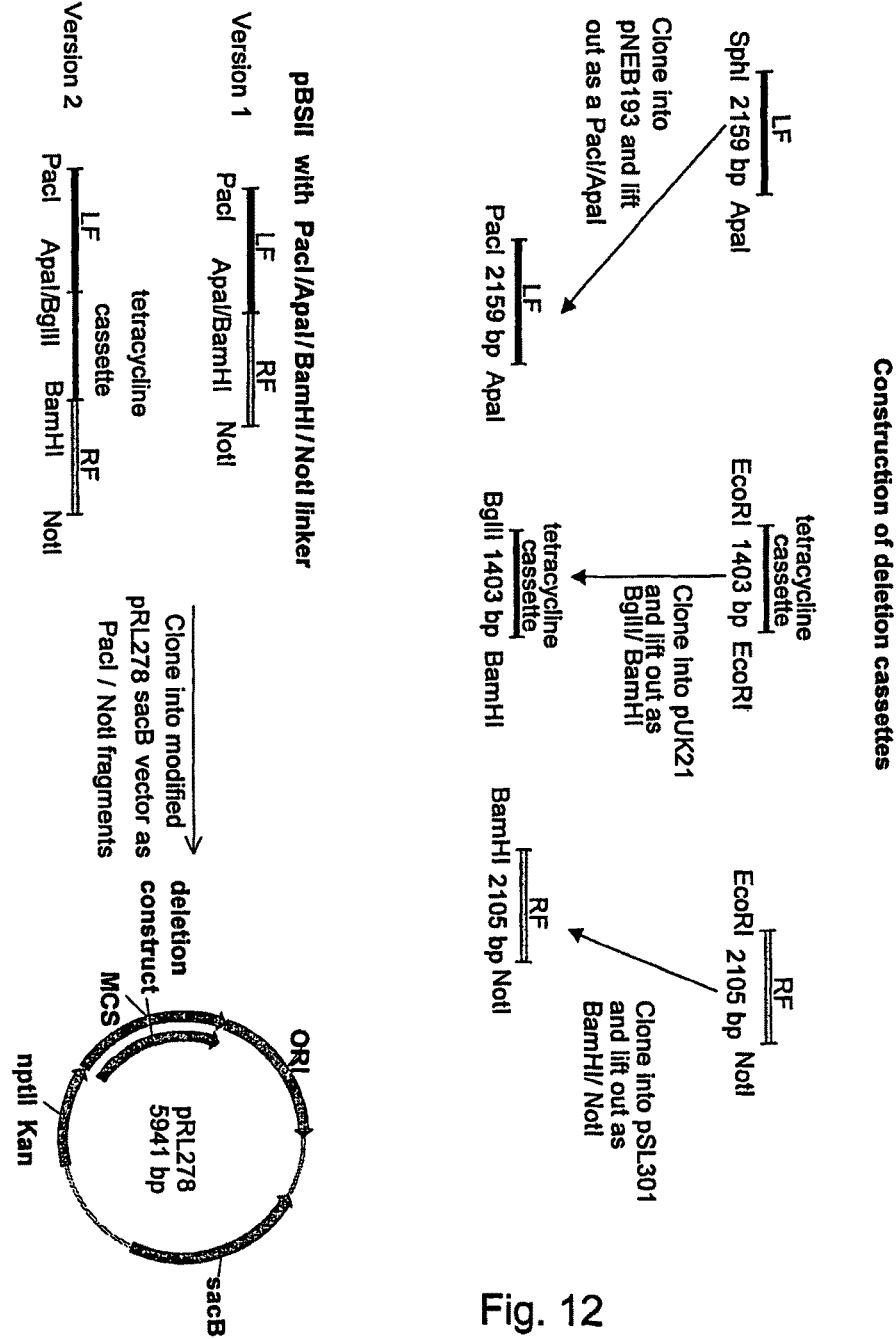

FIG. 12: Flow chart detailing the steps used to construct the deletion cassettes used to disarm strain K599.

Figure 13B:
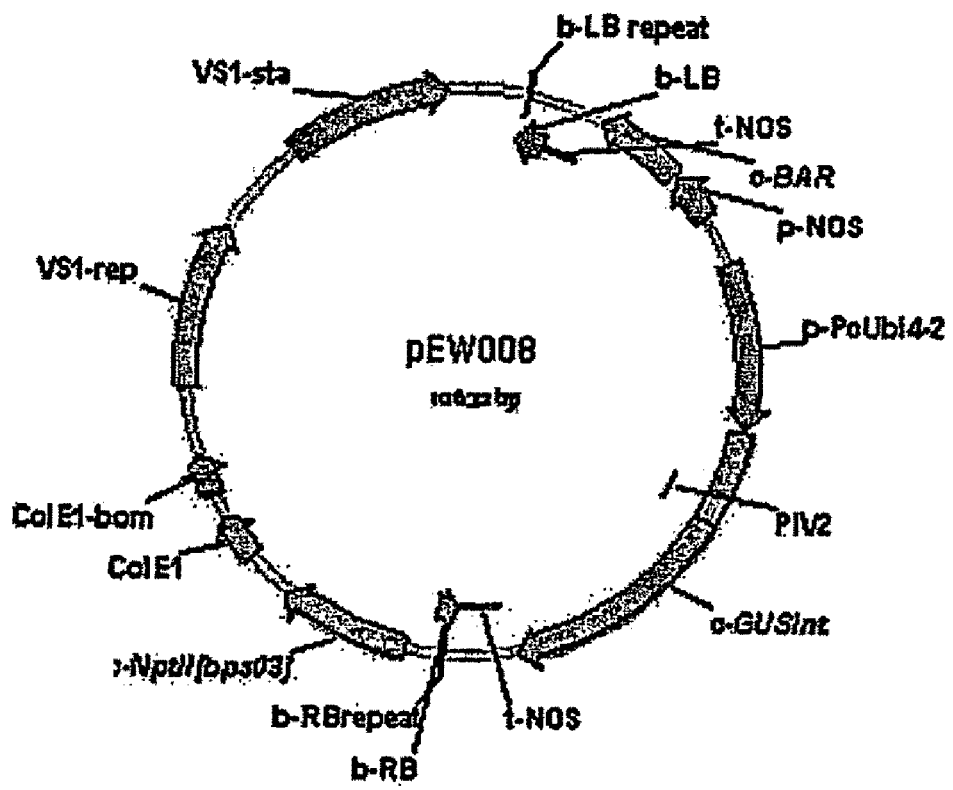

FIGS. 13A-13B: A: Plasmid maps of vector pBPSMM192b and pBPSMM232 B: Plasmid map of vector pBPSEW008.

FIG. 14: A-E: Alignment of various 16S-23S rRNA intergenic sequence regions of soil-born bacteria.

| K599: | *Agrobacterium* strain K599 (NCPPB 2659) |
|---|---|
| AE008980: | *Agrobacterium tumefaciens* C58 |
| AE009348: | *Agrobacterium tumefaciens* C58 |
| AE008265: | *Agrobacterium tumefaciens* C58 |
| AE007948: | *Agrobacterium tumefaciens* C58 |
| AE009201: | *Agrobacterium tumefaciens* C58 |
| U45329: | *Agrobacterium vitis*. NCPPB3554 |
| AE102735: | *Agrobacterium tumefaciens* (*Rhizobium radiobacter*) MAFF301001 |

*Agrobacterium* strain C58 has 4 rRNA operons. These are the closest known relatives to the 16S-23S rRNA intergenic sequence of K599. Other 16S-23S rRNA intergenic sequence from other *Agrobacterium* strains has low homology and did not pile up well. This shows that this region exhibits sufficient variability to be use as a signature sequence to differentiate *Agrobacterium* strain K599 from other closely related species. The 16S-23S rRNA intergenic sequence is a region between the 16S and 23S rRNA that usually codes for tRNA (such as e.g., Ile, Ala, Asp, Trp.)

Figure 15:
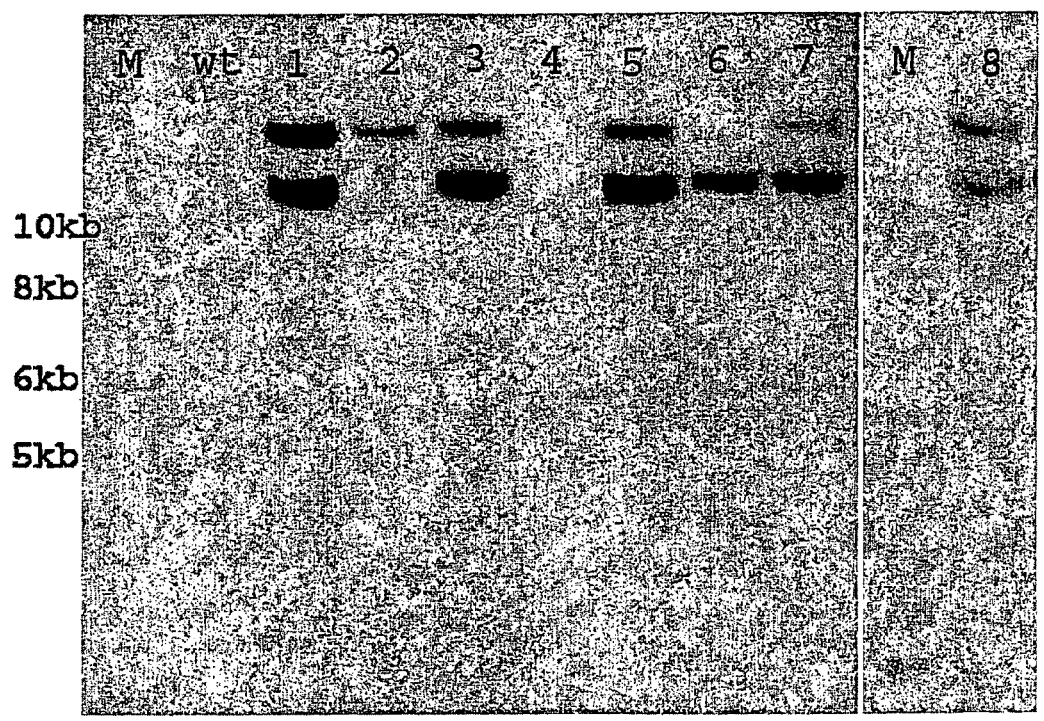

FIG. 15 Southern hybridization of soybean T1 and T0 plants transformed with disarmed *Agrobacterium* strain K599 (pRi2659Δ). Genomic DNA was digested with HindIII and probed with a gusINT gene. A single HindIII site is present in the T-DNA. M=1 kb marker; wt=non-transformed genomic DNA; lanes 1-7, individual T1 lines; lane 8, T0 plant.

Figure 16:
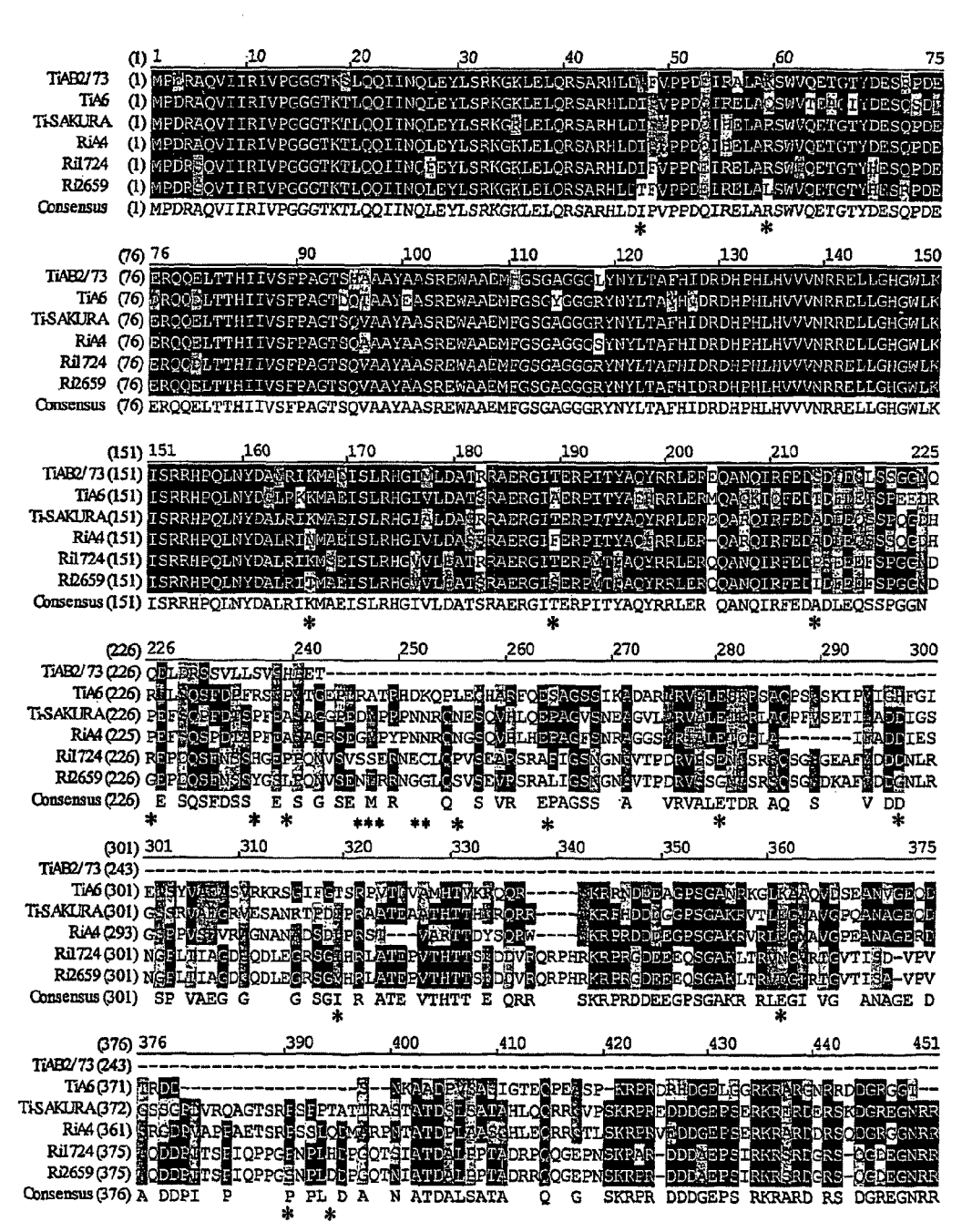

FIG. 16 Alignment of various virD2 amino acid sequences of *Agrobacterium* species. Unique mutations distinguishing the virD2 protein encoded by pRI2659 (SEQ ID NO: 112) over its known homologues are marked with asterixes (*).

| TiAB2/73: | *Agrobacterium tumefaciens* |
|---|---|
| TiA6: | *Agrobacterium tumefaciens* |
| Ti-SUKURA: | *Agrobacterium tumefaciens* |
| RiA4: | *Agrobacterium rhizogenes* |
| Ri1724: | *Agrobacterium rhizogenes* |
| Ri2659: | *Agrobacterium* strain K599 |

GENERAL DEFINITIONS

Abbreviations: BAP—6-benzylaminopurine; 2,4-D—2,4-dichlorophenoxyacetic acid; MS—Mura-shige and Skoog medium; NAA—1-naphtaleneacetic acid; MES, 2-(N-morpholino-ethanesulfonic acid, IAA indole acetic acid; Kan: Kanamycin sulfate; GA3—Gibberellic acid; TimentinTM: ticarcillin disodium/clavulanate potassium.

It is to be understood that this invention is not limited to the particular methodology, protocols, cell lines, plant species or genera, constructs, and reagents described as such. It is also to be understood that the terminology used herein is for the purpose of describing particular embodiments only, and is not intended to limit the scope of the present invention which will be limited only by the appended claims. It must be noted that as used herein and in the appended claims, the singular forms "a," "and," and "the" include plural reference unless the context clearly dictates otherwise. Thus, for example, reference to "a vector" is a reference to one or more vectors and includes equivalents thereof known to those skilled in the art, and so forth.

The term "about" is used herein to mean approximately, roughly, around, or in the region of. When the term "about" is used in conjunction with a numerical range, it modifies that range by extending the boundaries above and below the numerical values set forth. In general, the term "about" is used herein to modify a numerical value above and below the stated value by a variance of 20 percent, preferably 10 percent, up or down (higher or lower).

As used herein, the word "or" means any one member of a particular list and also includes any combination of members of that list.

"Agronomically valuable trait" includes any phenotype in a plant organism that is useful or advantageous for food production or food products, including plant parts and plant products. Non-food agricultural products such as paper, etc. are also included. A partial list of agronomically valuable traits includes pest resistance, vigor, development time (time to harvest), enhanced nutrient content, novel growth patterns, flavors or colors, salt, heat, drought and cold tolerance, and the like. Preferably, agronomically valuable traits do not include selectable marker genes (e.g., genes encoding herbicide or antibiotic resistance used only to facilitate detection or selection of transformed cells), hormone biosynthesis genes leading to the production of a plant hormone (e.g., auxins, gibberllins, cytokinins, abscisic acid and ethylene that are used only for selection), or reporter genes (e.g. luciferase, glucuronidase, chloramphenicol acetyl transferase (CAT, etc.). Such agronomically valuable important traits may include improvement of pest resistance (e.g., Melchers 2000), vigor, development time (time to harvest), enhanced nutrient content, novel growth patterns, flavors or colors, salt, heat, drought, and cold tolerance (e.g., Sakamoto 2000; Saijo 2000; Yeo 2000; Cushman 2000), and the like. Those of skill will recognize that there are numerous polynucleotides from which to choose to confer these and other agronomically valuable traits.

The term "nucleic acid" refers to deoxyribonucleotides or ribonucleotides and polymers or hybrids thereof in either single- or double-stranded, sense or antisense form. Unless otherwise indicated, a particular nucleic acid sequence also implicitly encompasses conservatively modified variants thereof (e.g., degenerate codon substitutions) and complementary sequences, as well as the sequence explicitly indicated. The term "nucleic acid" is used inter-changeably herein with "gene", "cDNA", "mRNA", "oligonucleotide," and "polynucleotide".

The phrase "nucleic acid sequence" refers to a single or double-stranded polymer of deoxyribonucleotide or ribonucleotide bases read from the 5'- to the 3'-end. It includes chromosomal DNA, self-replicating plasmids, infectious polymers of DNA or RNA and DNA or RNA that performs a primarily structural role. "Nucleic acid sequence" also refers to a consecutive list of abbreviations, letters, characters or words, which represent nucleotides. In one embodiment, a nucleic acid can be a "probe" which is a relatively short nucleic acid, usually less than 100 nucleotides in length. Often a nucleic acid probe is from about 50 nucleotides in length to about 10 nucleotides in length. A "target region" of a nucleic acid is a portion of a nucleic acid that is identified to be of interest. A "coding region" of a nucleic acid is the portion of the nucleic acid which is transcribed and translated in a sequence-specific manner to produce into a particular polypeptide or protein when placed under the control of appropriate regulatory sequences. The coding region is said to encode such a polypeptide or protein.

The term "nucleotide sequence of interest" refers to any nucleotide sequence, the manipulation of which may be deemed desirable for any reason (e.g., confer improved qualities), by one of ordinary skill in the art. Such nucleotide sequences include, but are not limited to, coding sequences of structural genes (e.g., reporter genes, selection marker genes, drug resistance genes, growth factors, etc.), and non-coding regulatory sequences which do not encode an mRNA or protein product, (e.g., promoter sequence, polyadenylation sequence, termination sequence, enhancer sequence, etc.). A nucleic acid sequence of interest may preferably encode for an agronomically valuable trait.

The term "antisense" is understood to mean a nucleic acid having a sequence complementary to a target sequence, for example a messenger RNA (mRNA) sequence the blocking of whose expression is sought to be initiated by hybridization with the target sequence.

The term "sense" is understood to mean a nucleic acid having a sequence which is homologous or identical to a target sequence, for example a sequence which binds to a protein transcription factor and which is involved in the expression of a given gene. According to a preferred embodiment, the nucleic acid comprises a gene of interest and elements allowing the expression of the said gene of interest.

The term "gene" refers to a coding region operably joined to appropriate regulatory sequences capable of regulating the expression of the polypeptide in some manner. A gene includes untranslated regulatory regions of DNA (e.g., promoters, enhancers, repressors, etc.) preceding (up-stream) and following (downstream) the coding region (open reading frame, ORF) as well as, where applicable, intervening sequences (i.e., introns) between individual coding regions (i.e., exons). The term "structural gene" as used herein is intended to mean a DNA sequence that is transcribed into mRNA, which is then translated into a sequence of amino acids characteristic of a specific polypeptide.

The term "genome" or "genomic DNA" is referring to the heritable genetic information of a host organism. Said genomic DNA comprises the DNA of the nucleus (also referred to as chromosomal DNA) but also the DNA of the plastids (e.g., chloroplasts) and other cellular organelles (e.g., mitochondria). Preferably the terms genome or genomic DNA is referring to the chromosomal DNA of the nucleus.

The term "chromosomal DNA" or "chromosomal DNA-sequence" is to be understood as the genomic DNA of the cellular nucleus independent from the cell cycle status. Chromosomal DNA might therefore be organized in chromosomes or chromatids, they might be condensed or uncoiled. An insertion into the chromosomal DNA can be demonstrated and analyzed by various methods known in the art like e.g., polymerase chain reaction (PCR) analysis, Southern blot analysis, fluorescence in situ hybridization (FISH), and in situ PCR.

As used herein the term "coding region" when used in reference to a structural gene refers to the nucleotide sequences which encode the amino acids found in the nascent polypeptide as a result of translation of a mRNA molecule. The coding region is bounded, in eukaryotes, on the 5'-side by the nucleotide triplet "ATG" which encodes the initiator methionine and on the 3'-side by one of the three triplets, which specify stop codons (i.e., TAA, TAG, TGA). In addition to containing introns, genomic forms of a gene may also include sequences located on both the 5'- and 3'-end of the sequences which are present on the RNA transcript. These sequences are referred to as "flanking" sequences or regions (these flanking sequences are located 5' or 3' to the non-translated sequences present on the mRNA transcript). The 5'-flanking region may contain regulatory sequences such as promoters and enhancers, which control or influence the transcription of the gene. The 3'-flanking region may contain sequences, which direct the termination of transcription, post-transcriptional cleavage and polyadenylation.

As used herein, the term "amino acid sequence" refers to a list of abbreviations, letters, characters or words representing amino acid residues. Amino acids may be referred to herein by either their commonly known three letter symbols or by the one-letter symbols recommended by the IUPAC-IUB Biochemical Nomenclature Commission. Nucleotides, likewise, may be referred to by their commonly accepted single-letter codes.

The terms "polypeptide", "peptide", "oligopeptide", "polypeptide", "gene product", "expression product" and "protein" are used interchangeably herein to refer to a polymer or oligomer of consecutive amino acid residues.

The term "isolated" as used herein means that a material has been removed from its original environment. For example, a naturally occurring polynucleotide or polypeptide present in a living animal is not isolated, but the same polynucleotide or polypeptide, separated from some or all of the coexisting materials in the natural system, is isolated. Such polynucleotides can be part of a vector and/or such polynucleotides or polypeptides could be part of a composition, and would be isolated in that such a vector or composition is not part of its original environment. Preferably, the term "isolated" when used in relation to a nucleic acid, as in "an isolated nucleic acid sequence" refers to a nucleic acid sequence that is identified and separated from at least one contaminant nucleic acid with which it is ordinarily associated in its natural source. Isolated nucleic acid is nucleic acid present in a form or setting that is different from that in which it is found in nature. In contrast, non-isolated nucleic acids are nucleic acids such as DNA and RNA which are found in the state they exist in nature. For example, a given DNA sequence (e.g., a gene) is found on the host cell chromosome in proximity to neighboring genes; RNA sequences, such as a specific mRNA sequence encoding a specific protein, are found in the cell as a mixture with numerous other mRNAs, which encode a multitude of proteins. However, an isolated nucleic acid sequence comprising for example SEQ ID NO: 18 includes, by way of example, such nucleic acid sequences in cells which ordinarily contain SEQ ID NO:18 where the nucleic acid sequence is in a chromosomal or extrachromosomal location different from that of natural cells, or is otherwise flanked by a different nucleic acid sequence than that found in nature. The isolated nucleic acid sequence may be present in single-stranded or double-stranded form. When an isolated nucleic acid sequence is to be utilized to express a protein, the nucleic acid sequence will contain at a minimum at least a portion of the sense or coding strand (i.e., the nucleic acid sequence may be single-stranded). Alternatively, it may contain both the sense and anti-sense strands (i.e., the nucleic acid sequence may be double-stranded).

As used herein, the term "purified" refers to molecules, either nucleic or amino acid sequences, that are removed from their natural environment, isolated or separated. An "isolated nucleic acid sequence" is therefore a purified nucleic acid sequence. "Substantially purified" molecules are at least 60% free, preferably at least 75% free, and more preferably at least 90% free from other components with which they are naturally associated.

The term "wild-type", "natural" or of "natural origin" means with respect to an organism, polypeptide, or nucleic acid sequence, that said organism is naturally occurring or available in at least one naturally occurring organism which is not changed, mutated; or otherwise manipulated by man.

A "polynucleotide construct" refers to a nucleic acid at least partly created by recombinant methods. The term "DNA construct" is referring to a polynucleotide construct consisting of deoxyribonucleotides. The construct may be single- or—preferably—double stranded. The construct may be circular or linear. The skilled worker is familiar with a variety of ways to obtain one of a DNA construct. Constructs can be prepared by means of customary recombination and cloning techniques as are described, for example, in Maniatis 1989, Silhavy 1984, and Ausubel 1987.

As used herein, the terms "complementary" or "complementarity" are used in reference to nucleotide sequences related by the base-pairing rules. For example, the sequence 5'-AGT-3' is complementary to the sequence 5'-ACT-3'. Complementarity can be "partial" or "total." "Partial" complementarity is where one or more nucleic acid bases is not matched according to the base pairing rules. "Total" or "complete" complementarity between nucleic acids is where each and every nucleic acid base is matched with another base under the base pairing rules. The degree of complementarity between nucleic acid strands has significant effects on the efficiency and strength of hybridization between nucleic acid strands. A "complement" of a nucleic acid sequence as used herein refers to a nucleotide sequence whose nucleic acids show total complementarity to the nucleic acids of the nucleic acid sequence.

The terms "homology" or "identity" when used in relation to nucleic acids refers to a degree of complementarity. Homology or identity between two nucleic acids is understood as meaning the identity of the nucleic acid sequence over in each case the entire length of the sequence, which is calculated by comparison with the aid of the program algorithm GAP (Wisconsin Package Version 10.0, University of Wisconsin, Genetics Computer Group (GCG), Madison, USA) with the parameters being set as follows:

| Gap Weight: 12 | Length Weight: 4 |
| Average Match: 2,912 | Average Mismatch: 2,003 |

For example, a sequence with at least 95% homology (or identity) to the sequence SEQ ID NO: 20 at the nucleic acid level is understood as meaning the sequence which, upon comparison with the sequence SEQ ID NO: 20 by the above program algorithm with the above parameter set, has at least 95% homology. There may be partial homology (i.e., partial identity of less then 100%) or complete homology (i.e., complete identity of 100%).

Alternatively, a partially complementary sequence is understood to be one that at least partially inhibits a completely complementary sequence from hybridizing to a target nucleic acid and is referred to using the functional term "substantially homologous." The inhibition of hybridization of the completely complementary sequence to the target sequence may be examined using a hybridization assay (Southern or Northern blot, solution hybridization and the like) under conditions of low stringency. A substantially homologous sequence or probe (i.e., an oligonucleotide which is capable of hybridizing to another oligonucleotide of interest) will compete for and inhibit the binding (i.e., the hybridization) of a completely homologous sequence to a target under conditions of low stringency. This is not to say that conditions of low stringency are such that non-specific binding is permitted; low stringency conditions require that the binding of two sequences to one another be a specific (i.e., selective) interaction. The absence of non-specific binding may be tested by the use of a second target which lacks even a partial degree of complementarity (e.g., less than about 30% identity); in the absence of non-specific binding the probe will not hybridize to the second non-complementary target.

When used in reference to a double-stranded nucleic acid sequence such as a cDNA or genomic clone, the term "substantially homologous" refers to any probe which can hybridize to either or both strands of the double-stranded nucleic acid sequence under conditions of low stringency as described infra. When used in reference to a single-stranded nucleic acid sequence, the term "substantially homologous" refers to any probe which can hybridize to the single-stranded nucleic acid sequence under conditions of low stringency as described infra.

The term "hybridization" as used herein includes "any process by which a strand of nucleic acid joins with a complementary strand through base pairing" (Coombs 1994). Hybridization and the strength of hybridization (i.e., the strength of the association between the nucleic acids) is impacted by such factors as the degree of complementarity between the nucleic acids, stringency of the conditions involved, the Tm of the formed hybrid, and the G:C ratio within the nucleic acids.

As used herein, the term "Tm" is used in reference to the "melting temperature." The melting temperature is the temperature at which a population of double-stranded nucleic acid molecules becomes half dissociated into single strands. The equation for calculating the Tm of nucleic acids is well known in the art. As indicated by standard references, a simple estimate of the Tm value may be calculated by the equation: $Tm=81.5+0.41(\% G+C)$, when a nucleic acid is in aqueous solution at 1 M NaCl [see e.g., Anderson and Young, Quantitative Filter Hybridization, in Nucleic Acid Hybridization (1985)]. Other references include more sophisticated computations which take structural as well as sequence characteristics into account for the calculation of Tm.

Low stringency conditions when used in reference to nucleic acid hybridization comprise conditions equivalent to binding or hybridization at 68° C. in a solution consisting of 5× SSPE (43.8 g/L NaCl, 6.9 g/L $NaH_2PO_4.H_2O$ and 1.85 g/L EDTA, pH adjusted to 7.4 with NaOH), 1% SDS, 5× Denhardt's reagent [50× Denhardt's contains the following per 500 mL: 5 g Ficoll (Type 400, Pharmacia), 5 g BSA (Fraction V; Sigma)] and 100 μg/mL denatured salmon sperm DNA followed by washing in a solution comprising 0.2× SSPE, and 0.1% SDS at room temperature when a DNA probe of about 100 to about 1,000 nucleotides in length is employed.

High stringency conditions when used in reference to nucleic acid hybridization comprise conditions equivalent to binding or hybridization at 68° C. in a solution consisting of 5× SSPE, 1% SDS, 5× Denhardt's reagent and 100 μg/mL denatured salmon sperm DNA followed by washing in a solution comprising 0.1× SSPE, and 0.1% SDS at 68° C. when a probe of about 100 to about 1,000 nucleotides in length is employed.

The term "equivalent" when made in reference to a hybridization condition as it relates to a hybridization condition of interest means that the hybridization condition and the hybridization condition of interest result in hybridization of nucleic acid sequences which have the same range of percent (%) homology. For example, if a hybridization condition of interest results in hybridization of a first nucleic acid sequence with other nucleic acid sequences that have from 80% to 90% homology to the first nucleic acid sequence, then another hybridization condition is said to be equivalent to the hybridization condition of interest if this other hybridization condition also results in hybridization of the first nucleic acid sequence with the other nucleic acid sequences that have from 80% to 90% homology to the first nucleic acid sequence.

When used in reference to nucleic acid hybridization the art knows well that numerous equivalent conditions may be employed to comprise either low or high stringency conditions; factors such as the length and nature (DNA, RNA, base composition) of the probe and nature of the target (DNA, RNA, base composition, present in solution or immobilized, etc.) and the concentration of the salts and other components (e.g., the presence or absence of formamide, dextran sulfate, polyethylene glycol) are considered and the hybridization solution may be varied to generate conditions of either low or high stringency hybridization different from, but equivalent to, the above-listed conditions. Those skilled in the art know that whereas higher stringencies may be preferred to reduce or eliminate non-specific binding, lower stringencies may be preferred to detect a larger number of nucleic acid sequences having different homologies.

"Transgene", "transgenic" or "recombinant" refers to an polynucleotide manipulated by man or a copy or complement of a polynucleotide manipulated by man. For instance, a transgenic expression cassette comprising a promoter operably linked to a second polynucleotide may include a promoter that is heterologous to the second polynucleotide as the result of manipulation by man (e.g., by methods described in Sambrook 1989, or Current Protocols in Molecular Biology Volumes 1-3, John Wiley & Sons, Inc. (1994-1998)) of an isolated nucleic acid comprising the expression cassette. In another example, a recombinant expression cassette may comprise polynucleotides combined in such a way that the polynucleotides are extremely unlikely to be found in nature. For instance, restriction sites or plasmid vector sequences manipulated by man may flank or separate the promoter from the second polynucleotide. One of skill will recognize that polynucleotides can be manipulated in many ways and are not limited to the examples above.

The term "transgenic" or "recombinant" as used herein (e.g., with regard to a plant cell or plant) is intended to refer to cells and/or plants which contains a transgene, or whose genome has been altered by the introduction of a transgene, or that have incorporated exogenous genes or DNA sequences, including but not limited to genes or DNA sequences which are perhaps not normally present, genes not normally transcribed and translated ("expressed") in a given cell type, or any other genes or DNA sequences which one desires to introduce into the non-transformed cell and/or plant, such as genes which may normally be present in the non-transformed cell and/or plant but which one desires to have altered expression. Preferably, the term "recombinant" with respect to nucleic acids as used herein means that the nucleic acid is covalently joined and adjacent to a nucleic acid to which it is not adjacent in its natural environment. Transgenic cells, tissues and plants may be produced by several methods including the introduction of a "transgene" comprising nucleic acid (usually DNA) into a target cell or integration of the transgene into a chromosome of a target cell by way of human intervention, such as by the methods described herein.

The term "transgene" as used herein refers to any nucleic acid sequence which is introduced into the genome of a cell by experimental manipulations. A transgene may be an "endogenous DNA sequence," or a "heterologous DNA sequence" (i.e., "foreign DNA"). The term "endogenous DNA sequence" refers to a nucleotide sequence which is naturally found in the cell into which it is introduced so long as it does not contain some modification (e.g., a point mutation, the presence of a selectable marker gene, etc.) relative to the naturally-occurring sequence.

The term "transgene" or "transgenic" with respect to, for example, a nucleic acid sequence (or an organism, expression construct or vector comprising said nucleic acid sequence) refers to all those constructs originating by experimental manipulations in which either
a) said nucleic acid sequence, or
b) a genetic control sequence linked operably to said nucleic acid sequence a), for example a promoter, or
c) (a) and (b)
is not located in its natural genetic environment or has been modified by experimental manipulations, an example of a modification being a substitution, addition, deletion, inversion or insertion of one or more nucleotide residues. Natural genetic environment refers to the natural chromosomal locus in the organism of origin, or to the presence in a genomic library. In the case of a genomic library, the natural genetic environment of the nucleic acid sequence is preferably retained, at least in part. The environment flanks the nucleic acid sequence at least at one side and has a sequence of at least 50 bp, preferably at least 500 bp, especially preferably at least 1,000 bp, very especially preferably at least 5,000 bp, in length. A naturally occurring expression construct —for example the naturally occurring combination of a promoter with the corresponding gene—becomes a transgenic expression construct when it is modified by non-natural, synthetic "artificial" methods such as, for example, mutagenization. Such methods have been described (U.S. Pat. No. 5,565,350; WO 00/15815).

The terms "heterologous nucleic acid sequence" or "heterologous DNA" are used inter-changeably to refer to a nucleotide sequence, which is ligated to, or is manipulated to become ligated to, a nucleic acid sequence to which it is not ligated in nature, or to which it is ligated at a different location in nature. Heterologous DNA is not endogenous to the cell into which it is introduced, but has been obtained from another cell. Heterologous DNA also includes an endogenous DNA sequence, which contains some modification. Generally, although not necessarily, heterologous DNA encodes RNA and proteins that are not normally produced by the cell into which it is expressed. Examples of heterologous DNA include reporter genes, transcriptional and translational regulatory sequences, selectable marker proteins (e.g., proteins which confer drug resistance), etc. Preferably, the term "transgenic" or "recombinant" with respect to a regulatory sequence (e.g., a promoter of the invention) means that said regulatory sequence is covalently joined and adjacent to a nucleic acid to which it is not adjacent in its natural environment.

The term "foreign gene" refers to any nucleic acid (e.g., gene sequence) which is introduced into the genome of a cell by experimental manipulations and may include gene sequences found in that cell so long as the introduced gene contains some modification (e.g., a point mutation, the presence of a selectable marker gene, etc.) relative to the naturally-occurring gene.

"Recombinant" polypeptides or proteins refer to polypeptides or proteins produced by recombinant DNA techniques, i.e., produced from cells transformed by an exogenous recombinant DNA construct encoding the desired polypeptide or protein. Recombinant nucleic acids and polypeptide may also comprise molecules, which as such does not exist in nature but are modified, changed, mutated or otherwise manipulated by man. Preferably, a "recombinant polypeptide" is a non-naturally occurring polypeptide that differs in sequence from a naturally occurring polypeptide by at least one amino acid residue. Preferred methods for producing said recombinant polypeptide and/or nucleic acid may comprise directed or non-directed mutagenesis, DNA shuffling or other methods of recursive recombination.

The term "genetically-modified organism" or "GMO" refers to any organism that comprises transgene DNA. Exemplary organisms include plants, animals and microorganisms.

The term "cell" or "plant cell" as used herein refers to a single cell. The term "cells" refers to a population of cells. The population may be a pure population comprising one cell type. Likewise, the population may comprise more than one cell type. In the present invention, there is no limit on the number of cell types that a cell population may comprise. The cells may be synchronized or not synchronized. A plant cell within the meaning of this invention may be isolated (e.g., in suspension culture) or comprised in a plant tissue, plant organ or plant at any developmental stage.

The term "organ" with respect to a plant (or "plant organ") means parts of a plant and may include (but shall not limited to) for example roots, fruits, shoots, stem, leaves, anthers, sepals, petals, pollen, seeds, etc.

The term "tissue" with respect to a plant (or "plant tissue") means arrangement of multiple plant cells including differentiated and undifferentiated tissues of plants. Plant tissues may constitute part of a plant organ (e.g., the epidermis of a plant leaf) but may also constitute tumor tissues (e.g., callus tissue) and various types of cells in culture (e.g., single cells, protoplasts, embryos, calli, protocorm-like bodies, etc.). Plant tissue may be in planta, in organ culture, tissue culture, or cell culture.

The term "plant" as used herein refers to a plurality of plant cells, which are largely differentiated into a structure that is present at any stage of a plant's development. Such structures include one or more plant organs including, but are not limited to, fruit, shoot, stem, leaf, flower petal, etc. Preferably, the term "plant" includes whole plants, shoot vegetative organs/structures (e.g. leaves, stems and tubers), roots, flowers and floral organs/structures (e.g. bracts, sepals, petals, stamens, carpels, anthers and ovules), seeds (including embryo, endosperm, and seed coat) and fruits (the mature ovary), plant tissues (e.g. vascular tissue, ground tissue, and the like) and cells (e.g. guard cells, egg cells, trichomes and the like), and progeny of same. The class of plants that can be used in the method of the invention is generally as broad as the class of higher and lower plants amenable to transformation techniques, including angiosperms (monocotyledonous and dicotyledonous plants), gymnosperms, ferns, and multicellular algae. It includes plants of a variety of ploidy levels, including aneuploid, polyploid, diploid, haploid and hemizygous. Included within the scope of the invention are all genera and species of higher and lower plants of the plant kingdom. Included are furthermore the mature plants, seed, shoots and seedlings, and parts, propagation material (for example seeds and fruit) and cultures, for example cell cultures, derived therefrom. Preferred are plants and plant materials of the following plant families: Amaranthaceae, Brassicaceae, Carophyllaceae, Chenopodiaceae, Compositae, Cucurbitaceae, Labiatae, Leguminosae, Papilionoideae, Liliaceae, Linaceae, Malvaceae, Rosaceae, Saxifragaceae, Scrophulariaceae, Solanaceae, Tetragoniaceae.

Annual, perennial, monocotyledonous and dicotyledonous plants are preferred host organisms for the generation of transgenic plants. The use of the recombination system, or method according to the invention is furthermore advantageous in all ornamental plants, forestry, fruit, or ornamental trees, flowers, cut flowers, shrubs or turf. Said plant may include—but shall not be limited to—bryophytes such as, for example, Hepaticae (hepaticas) and Musci (mosses); pteridophytes such as ferns, horsetail and clubmosses; gymnosperms such as conifers, cycads, ginkgo and Gnetaeae; algae such as Chlorophyceae, Phaeophpyceae, Rhodophyceae, Myxophyceae, Xanthophyceae, Bacillariophyceae (diatoms) and Euglenophyceae.

Plants for the purposes of the invention may comprise the families of the Rosaceae such as rose, Ericaceae such as rhododendrons and azaleas, Euphorbiaceae such as poinsettias and croton, Caryophyllaceae such as pinks, Solanaceae such as petunias, Gesneriaceae such as African violet, Balsaminaceae such as touch-me-not, Orchidaceae such as orchids, Iridaceae such as gladioli, iris, freesia and crocus, Compositae such as marigold, Geraniaceae such as geraniums, Liliaceae such as *Drachaena*, Moraceae such as ficus, Araceae such as philodendron and many others.

The transgenic plants according to the invention are furthermore selected in particular from among dicotyledonous crop plants such as, for example, from the families of the Leguminosae such as pea, alfalfa and soybean; the family of the Umbelliferae, particularly the genus *Daucus* (very particularly the species *carota* (carrot)) and *Apium* (very particularly the species *graveolens* var. *dulce* (celery)) and many others; the family of the Solanaceae, particularly the genus *Lycopersicon*, very particularly the species *esculentum* (tomato) and the genus *Solanum*, very particularly the species *tuberosum* (potato) and *melongena* (aubergine), tobacco and many others; and the genus *Capsicum*, very particularly the species *annum* (pepper) and many others; the family of the Leguminosae, particularly the genus *Glycine*, very particularly the species *max* (soybean) and many others; and the family of the Cruciferae, particularly the genus *Brassica*, very particularly the species *napus* (oilseed rape), *campestris* (beet), *oleracea* cv Tastie (cabbage), *oleracea* cv Snowball Y (cauliflower) and *oleracea* cv Emperor (broccoli); and the genus *Arabidopsis*, very particularly the species *thaliana* and many others; the family of the Compositae, particularly the genus *Lactuca*, very particularly the species *sativa* (lettuce) and many others.

The transgenic plants according to the invention are selected in particular among monocotyledonous crop plants, such as, for example, cereals such as wheat, barley, sorghum and millet, rye, triticale, maize, rice or oats, and sugarcane. Further preferred are trees such as apple, pear, quince, plum, cherry, peach, nectarine, apricot, papaya, mango, and other woody species including coniferous and deciduous trees such as poplar, pine, sequoia, cedar, oak, etc. Especially preferred are *Arabidopsis thaliana, Nicotiana tabacum*, oilseed rape, soybean, corn (maize), wheat, linseed, potato and tagetes.

The "efficiency of transformation" or "frequency of transformation" as used herein can be measured by the number of transformed cells (or transgenic organisms grown from individual transformed cells) that are recovered under standard experimental conditions (i.e. standardized or normalized with respect to amount of cells contacted with foreign DNA, amount of delivered DNA, type and conditions of DNA delivery, general culture conditions etc.). For example, when isolated petioles are used as starting material for transformation, the frequency of transformation can be expressed as the number of transgenic shoots (or resulting fertile plant lines) obtained per transformed petiole.

The term "expression" refers to the biosynthesis of a gene product. For example, in the case of a structural gene, expression involves transcription of the structural gene into mRNA and—optionally—the subsequent translation of mRNA into one or more polypeptides.

The term "expression cassette" or "expression construct" as used herein is intended to mean the combination of any nucleic acid sequence to be expressed in operable linkage with a promoter sequence and—optionally—additional elements (like e.g., terminator and/or polyadenylation sequences) which facilitate expression of said nucleic acid sequence.

The term "promoter," "promoter element," or "promoter sequence" as used herein, refers to a DNA sequence which when ligated to a nucleotide sequence of interest is capable of controlling the transcription of the nucleotide sequence of interest into mRNA. A promoter is typically, though not necessarily, located 5' (i.e., upstream) of a nucleotide sequence of interest (e.g., proximal to the transcriptional start site of a structural gene) whose transcription into mRNA it controls, and provides a site for specific binding by RNA polymerase and other transcription factors for initiation of transcription. A polynucleotide sequence is "heterologous to" an organism or a second polynucleotide sequence if it originates from a foreign species, or, if from the same species, is modified from its original form. For example, a promoter operably linked to a heterologous coding sequence refers to a coding sequence from a species different from that from which the promoter was derived, or, if from the same species, a coding sequence which is not naturally associated with the promoter (e.g. a genetically engineered coding sequence or an allele from a different ecotype or variety). Suitable promoters can be derived from plants or plant pathogens like e.g., plant viruses.

If a promoter is an inducible promoter, then the rate of transcription increases in response to an inducing agent. In contrast, the rate of transcription is not regulated by an inducing agent if the promoter is a constitutive promoter. Also, the promoter may be regulated in a tissue-specific or tissue preferred manner such that it is only active in transcribing the associated coding region in a specific tissue type(s) such as leaves, roots or meristem. The term "tissue specific" as it applies to a promoter refers to a promoter that is capable of directing selective expression of a nucleotide sequence of interest to a specific type of tissue (e.g., petals) in the relative absence of expression of the same nucleotide sequence of interest in a different type of tissue (e.g., roots). Tissue specificity of a promoter may be evaluated by, for example, operably linking a reporter gene to the promoter sequence to generate a reporter construct, introducing the reporter construct into the genome of a plant such that the reporter construct is integrated into every tissue of the resulting transgenic plant, and detecting the expression of the reporter gene (e.g., detecting mRNA, protein, or the activity of a protein encoded by the reporter gene) in different tissues of the transgenic plant. The detection of a greater level of expression of the reporter gene in one or more tissues relative to the level of expression of the reporter gene in other tissues shows that the promoter is specific for the tissues in which greater levels of expression are detected. The term "cell type specific" as applied to a promoter refers to a promoter which is capable of directing selective expression of a nucleotide sequence of interest in a specific type of cell in the relative absence of expression of the same nucleotide sequence of interest in a different type of cell within the same tissue. The term "cell type specific" when applied to a promoter also means a promoter capable of promoting selective expression of a nucleotide sequence of interest in a region within a single tissue. Cell type specificity of a promoter may be assessed using methods well known in the art, e.g., GUS activity staining (as described for example in Example 7) or immunohistochemical staining. Briefly, tissue sections are embedded in paraffin, and paraffin sections are reacted with a primary antibody which is specific for the polypeptide product encoded by the nucleotide sequence of interest whose expression is controlled by the promoter. A labeled (e.g., peroxidase conjugated) secondary antibody, which is specific for the primary antibody, is allowed to bind to the sectioned tissue and specific binding detected (e.g., with avidin/biotin) by microscopy. Promoters may be constitutive or regulatable. The term "constitutive" when made in reference to a promoter means that the promoter is capable of directing transcription of an operably linked nucleic acid sequence in the absence of a stimulus (e.g., heat shock, chemicals, light, etc.). Typically, constitutive promoters are capable of directing expression of a transgene in substantially any cell and any tissue. In contrast, a "regulatable" promoter is one which is capable of directing a level of transcription of an operably linked nuclei acid sequence in the presence of a stimulus (e.g., heat shock, chemicals, light, etc.) which is different from the level of transcription of the operably linked nucleic acid sequence in the absence of the stimulus.

Where expression of a gene in all tissues of a transgenic plant or other organism is desired, one can use a "constitutive" promoter, which is generally active under most environmental conditions and states of development or cell differentiation (Benfey 1989). Useful promoters for plants also include those obtained from Ti- or Ri-plasmids, from plant cells, plant viruses or other organisms whose promoters are found to be functional in plants. Bacterial promoters that function in plants, and thus are suitable for use in the methods of the invention include the octopine synthetase promoter, the nopaline synthase promoter, and the mannopine synthetase promoter. The promoter controlling expression of the trait gene and/or selection marker can be constitutive. Suitable constitutive promoters for use in plants include, for example, the cauliflower mosaic virus (CaMV) 35S transcription initiation region (Franck 1980; Odell 1985; Shewmaker 1985; Gardner 1986), the 19S transcription initiation region (U.S. Pat. No. 5,352,605 and WO 84/02913), and region VI promoters, the 1'- or 2'-promoter derived from T-DNA of *Agrobacterium tumefaciens*, and other promoters active in plant cells that are known to those of skill in the art. Other suitable promoters include the full-length transcript promoter from Figwort mosaic virus, actin promoters (e.g., the rice actin promoter; McElroy 1990), histone promoters, tubulin promoters, or the mannopine synthase promoter (MAS). Other constitutive plant promoters include various ubiquitin or poly-ubiquitin promoters (Sun 1997; Christensen 1989, 1992; Bruce 1989; Holtorf 1995), the mas, Mac or DoubleMac promoters (U.S. Pat. No. 5,106,739; Comai 1990), the ubiquitin promoter (Holtorf 1995), Rubisco small subunit (SSU) promoter (U.S. Pat. No. 4,962,028), the legumin B promoter (GenBank Acc. No. X03677), the promoter of the nopaline synthase (NOS) from *Agrobacterium*, the TR dual promoter, the octopine synthase (OCS) promoter from *Agrobacterium*, the Smas promoter, the cinnamyl alcohol dehydrogenase promoter (U.S. Pat. No. 5,683,439), the promoters of the vacuolar ATPase subunits, the pEMU promoter (Last 1991); the MAS promoter (Velten 1984), the maize H3 histone promoter (Lepetit 1992; Atanassova 1992), α-conglycinin promoter, the phaseolin promoter, the ADH promoter, and heatshock promoters, the nitrilase promoter from *Arabidopsis thaliana* (WO 03/008596; GenBank Acc. No.: U38846, nucleotides 3,862 to 5,325 or else 5342), promoter of a proline-rich protein from wheat (WO 91/13991), the promoter of the *Pisum sativum* ptxA gene, and other transcription initiation regions from various plant genes known to those of skill in the art.

Of course, promoters can regulate expression all of the time in only one or some tissues. Alternatively, a promoter can regulate expression in all tissues but only at a specific developmental time point. As noted above, the excision promoter (i.e., the promoter that is linked to the sequence-specific DNA cleaving polynucleotide) is generally not constitutive, but instead is active for only part of the life cycle or at least one tissue of the transgenic organism. One can use a promoter that directs expression of a gene of interest in a specific tissue or is otherwise under more precise environmental or developmental control. Examples of environmental conditions that may affect transcription by inducible promoters include pathogen attack, anaerobic conditions, ethylene or the presence of light. Promoters under developmental control include promoters that initiate transcription only in certain tissues or organs, such as leaves, roots, fruit, seeds, or flowers, or parts thereof. The operation of a promoter may also vary depending on its location in the genome. Thus, an inducible promoter may become fully or partially constitutive in certain locations. Examples of tissue-specific plant promoters under developmental control include promoters that initiate transcription only in certain tissues, such as fruit, seeds, flowers, anthers, ovaries, pollen, the meristem, flowers, leaves, stems, roots and seeds. The tissue-specific ES promoter from tomato is particularly useful for directing gene expression so that a desired gene product is located in fruits (see, e.g., Lincoln 1988; Deikman 1988, 1992). Other suitable seed specific promoters include those derived from the following genes: MAC1 from maize (Sheridan 1996), Cat3 from maize (GenBank No. L05934, Abler 1993), the gene encoding oleosin 18 kD from maize (GenBank No. J05212, Lee 1994) viviparous-1 from *Arabidopsis* (Genbank Acc.-No. U93215), the gene encoding oleosin from *Arabidopsis* (Genbank Acc.-No. Z17657), Atmycl from *Arabidopsis* (Urao 1996), the 2S seed storage protein gene family from *Arabidopsis* (Conceicao 1994) the gene encoding oleosin 20 kD from *Brassica napus* (GenBank No. M63985), napin from *Brassica napus* (GenBank No. J02798, Josefsson 1987), the napin gene family (e.g., from *Brassica napus*; Sjodahl 1995), U.S. Pat. No. 5,608,152; Stalberg 1996), the gene encoding the 2S storage protein from *Brassica napus* (Dasgupta 1993), the genes encoding oleosin A (Genbank Acc.-No. U09118) and oleosin B (Genbank No. U09119) from soybean, the gene encoding low molecular weight sulphur rich protein from soybean (Choi 1995), the phaseolin gene (U.S. Pat. No. 5,504,200, Bustos 1989; Murai 1983; Sengupta-Gopalan 1985), the 2S albumin gene (Joseffson 1987), the legumin gene (Shirsat 1989), the USP (unknown seed protein) gene (Bäumlein 1991), the sucrose binding protein gene (WO 00/26388), the legumin B4 gene (LeB4; Bäumlein 1991a,b; 1992; Fiedler 1995), the *Arabidopsis* oleosin gene (WO 98/45461), the *Brassica* Bce4 gene (WO 91/13980), genes encoding the "high-molecular-weight glutenin" (HMWG), gliadin, branching enzyme, ADP-glucose pyrophosphatase (AGPase) or starch synthase. Furthermore preferred promoters are those which enable seed-specific expression in monocots such as maize, barley, wheat, rye, rice and the like. Promoters which may advantageously be employed are the promoter of the Ipt2 or Ipt1 gene (WO 95/15389, WO 95/23230) or the promoters described in WO 99/16890 (promoters of the hordein gene, the glutelin gene, the oryzin gene, the prolamine gene, the gliadin gene, the zein gene, the kasirin gene or the secalin gene). Further preferred are a leaf-specific and light-induced promoter such as that from cab or Rubisco (Simpson 1985; Timko 1985); an anther-specific promoter such as that from LAT52 (Twell 1989b); a pollen-specific pro-moter such as that from Zml3 (Guerrero 1993); and a microspore-preferred promoter such as that from apg (Twell 1993). Further suitable promoters are, for example, specific promoters for tubers, storage roots or roots such as, for example, the class I patatin promoter (B33), the potato cathepsin D inhibitor promoter, the starch synthase (GBSS1) promoter or the sporamin promoter, and fruit-specific promoters such as, for example, the tomato fruit-specific pro-moter EP-A 409 625).

Promoters which are furthermore suitable are those which ensure leaf-specific expression. Promoters which may be mentioned are the potato cytosolic FBPase promoter (WO 98/18940), the Rubisco (ribulose-1,5-bisphosphate carboxylase) SSU (small subunit) promoter or the potato ST-LSI promoter (Stockhaus 1989). Other preferred promoters are those which govern expression in seeds and plant embryos.

Further suitable promoters are, for example, fruit-maturation-specific promoters such as, for example, the tomato fruit-maturation-specific promoter (WO 94/21794), flower-specific promoters such as, for example, the phytoene synthase promoter (WO 92/16635) or the promoter of the P1-rr gene (WO 98/22593) or another node-specific promoter as described in EP-A 249676 may be used advantageously. The promoter may also be a pith-specific promoter, such as the promoter isolated from a plant TrpA gene as described in WO 93/07278. A development-regulated promoter is, inter alia, described (Baerson 1993).

An expression cassettes may also contain a chemically inducible promoter (review article: Gatz 1997), by means of which the expression of the exogenous gene in the plant can be controlled at a particular point in time. Such promoters such as, for example, the PRP1 promoter (Ward 1993), a salicylic acid-inducible promoter (WO 95/19443), a benzenesulfonamide-inducible promoter (EP 0 388 186), a tetracyclin-inducible promoter (Gatz 1991, 1992), an abscisic acid-inducible promoter EP 0 335 528) or an ethanol-cyclohexanone-inducible promoter (WO 93/21334) can likewise be used. Also suitable is the promoter of the glutathione-S transferase isoform II gene (GST-II-27), which can be activated by exogenously applied safeners such as, for example, N,N-diallyl-2,2-dichloroacetamide (WO 93/01294) and which is operable in a large number of tissues of both monocotyledonous and dicotyledonous. Further exemplary inducible promoters that can be utilized in the instant invention include that from the ACE1 system which responds to copper (Mett 1993); or the In2 promoter from maize which responds to benzenesulfonamide herbicide safeners (Hershey 1991; Gatz 1994). A promoter that responds to an inducing agent to which plants do not normally respond can be utilized. An exemplary inducible promoter is the inducible promoter from a steroid hormone gene, the transcriptional activity of which is induced by a glucocorticosteroid hormone (Schena 1991). Other preferred promoters are promoters induced by biotic or abiotic stress, such as, for example, the pathogen-inducible promoter of the PRP1 gene (Ward 1993), the tomato heat-inducible hsp80 promoter (U.S. Pat. No. 5,187,267), the potato chill-inducible alpha-amylase promoter (WO 96/12814) or the wound-induced pinII promoter (EP-A1 0 375 091).

Promoters may also encompass further promoters, promoter elements or minimal promoters capable of modifying the expression-specific characteristics. Thus, for example, the tissue-specific expression may take place in addition as a function of certain stress factors, owing to genetic control sequences. Such elements are, for example, described for water stress, abscisic acid (Lam 1991) and heat stress (Schoffl 1989).

The term "operable linkage" or "operably linked" is to be understood as meaning, for example, the sequential arrangement of a regulatory element (e.g. a promoter) with a nucleic acid sequence to be expressed and, if appropriate, further regulatory elements (such as e.g., a terminator) in such a way that each of the regulatory elements can fulfill its intended function to allow, modify, facilitate or otherwise influence expression of said nucleic acid sequence. The expression may result depending on the arrangement of the nucleic acid sequences in relation to sense or antisense RNA. To this end, direct linkage in the chemical sense is not necessarily required. Genetic control sequences such as, for example, enhancer sequences, can also exert their function on the target sequence from positions which are further away, or indeed from other DNA molecules. Preferred arrangements are those in which the nucleic acid sequence to be expressed recombinantly is positioned behind the sequence acting as promoter, so that the two sequences are linked covalently to each other. The distance between the promoter sequence and the nucleic acid sequence to be expressed recombinantly is preferably less than 200 base pairs, especially preferably less than 100 base pairs, very especially preferably less than 50 base pairs. Operable linkage, and an expression construct, can be generated by means of customary recombination and cloning techniques as described (e.g., in Maniatis 1989; Silhavy 1984; Ausubel 1987; Gelvin 1990). However, further sequences which, for example, act as a linker with specific cleavage sites for restriction enzymes, or as a signal peptide, may also be positioned between the two sequences. The insertion of sequences may also lead to the expression of fusion proteins. Preferably, the expression construct, consisting of a linkage of promoter and nucleic acid sequence to be expressed, can exist in a vector-integrated form and be inserted into a plant genome, for example by transformation.

The term "transformation" as used herein refers to the introduction of genetic material (e.g., a transgene) into a cell. Transformation of a cell may be stable or transient. The term "transient transformation" or "transiently transformed" refers to the introduction of one or more transgenes into a cell in the absence of integration of the transgene into the host cell's genome. Transient transformation may be detected by, for example, enzyme-linked immunosorbent assay (ELISA) which detects the presence of a polypeptide encoded by one or more of the transgenes. Alternatively, transient transformation may be detected by detecting the activity of the protein (e.g., β-glucuronidase) encoded by the transgene (e.g., the uid A gene) as demonstrated herein [e.g., histochemical assay of GUS enzyme activity by staining with X-gluc which gives a blue precipitate in the presence of the GUS enzyme; and a chemiluminescent assay of GUS enzyme activity using the GUS-Light kit (Tropix)]. The term "transient transformant" refers to a cell which has transiently incorporated one or more transgenes. In contrast, the term "stable transformation" or "stably transformed" refers to the introduction and integration of one or more transgenes into the genome of a cell, preferably resulting in chromosomal integration and stable heritability through meiosis. Stable transformation of a cell may be detected by Southern blot hybridization of genomic DNA of the cell with nucleic acid sequences which are capable of binding to one or more of the transgenes. Alternatively, stable transformation of a cell may also be detected by the polymerase chain reaction of genomic DNA of the cell to amplify transgene sequences. The term "stable transformant" refers to a cell which has stably integrated one or more transgenes into the genomic DNA. Thus, a stable transformant is distinguished from a transient transformant in that, whereas genomic DNA from the stable transformant contains one or more transgenes, genomic DNA from the transient transformant does not contain a transgene. Transformation also includes introduction of genetic material into plant cells in the form of plant viral vectors involving epichromosomal replication and gene expression which may exhibit variable properties with respect to meiotic stability.

The terms "infecting" and "infection" with a bacterium refer to co-incubation of a target biological sample, (e.g., cell, tissue, etc.) with the bacterium under conditions such that nucleic acid sequences contained within the bacterium are introduced into one or more cells of the target biological sample.

The terms "meristem" or "meristematic cells" or "meristematic tissue" can be used interchangeable and are intended to mean undifferentiated plant tissue, which continually divides, forming new cells, as that found at the tip of a stem or root.

The term "node" is intended to mean the point on a stem where a leaf is attached or has been attached. The term "internode" is intended to mean the section or part between two nodes on a stem.

The term "petiole" is intended to mean the stalk by which a leaf is attached to a stem, also called a leaf-stalk.

The term "axillary bud" is intended to mean a small protuberance along a stem or branch, sometimes enclosed in protective scales and containing an undeveloped shoot, leaf, or flower; also called a lateral bud.

The term "hypocotyl" is intended to mean the part of the stem between the seed leaves (the cotyledons) and the root. The term "leaf axil" is intended to mean the angle between a leaf and the stem on which it is borne. The axillary bud occurs at the leaf axil.

The term "cotyledon" is intended to mean a leaf of the embryo of a seed plant, which upon germination either remains in the seed or emerges, enlarges, and becomes green; also called a seed leaf. The soybean seed consists of two seed halves, which are cotyledons or seed leaves. The two cotyledons contain food and nutrient reserves that nourish the seedling until it becomes established. Cotyledon color is green in the developing pod but in present grain varieties, it turns yellow as the plants mature. The embryo axis is located between the cotyledons and is attached to them near the end closest to the micropyle.

The term "*Agrobacterium*" as used herein refers to a soil-borne, Gram-negative, rod-shaped phytopathogenic bacterium. *Agrobacterium* together with *Rhizobium, Sinorhizobium*, and *Allorhizobium* are genera within the bacterial family Rhizobiaceae (Kersters and De Ley. 1984) which has been included in the alpha-2 subclass of Proteobacteria on the basis of ribosomal characteristics (Willems and Collins. 1993). Members of this family are aerobic, Gram-negative. The cells are normally rod-shaped (0.6-1.0 µm by 1.5-3.0 µm), occur singly or in pairs, without endospore, and are motile by one to six peritrichous flagella. Considerable extracellular polysaccharide slime is usually produced during growth on carbohydrate-containing media. The species of *Agrobacterium, Agrobacterium tumefaciens* (syn. *Agrobacterium radiobacter*), *Agrobacterium rhizogenes, Agrobacterium rubi* and *Agrobacterium vitis*, together with *Allorhizobium undicola*, form a monophyletic group with all *Rhizobium* species, based on comparative 16S rDNA analyses (Sawada 1993, Young 2003). *Agrobacterium* is an artificial genus comprising plant-pathogenic species. The monophyletic nature of *Agrobacterium, Allorhizobium* and *Rhizobium* and their common phenotypic generic circumscription support their amalgamation into a single genus, *Rhizobium*. The classification and characterization of *Agrobacterium* strains including differentiation of *Agrobacterium tumefaciens* and *Agrobacterium rhizogenes* and their various opine-type classes is a practice well known in the art (see for example Laboratory guide for identification of plant pathogenic bacteria, 3rd edition. (2001) N. W. Schaad, J. B. Jones, and W. Chun (eds.) ISBN 0890542635; for example the article of Moore et al. published therein).

Recent analyses demonstrate that classification by its plant-pathogenic properties is not justified. Accordingly more advanced methods based on genome analysis and comparison (such as 16S rRNA sequencing; RFLP, Rep-PCR, etc.) are employed to elucidate the relationship of the various strains (see for example Young 2003, Farrand 2003, de Bruijn 1996, Vinuesa 1998). Agrobacteria can be differentiated into at least three biovars, corresponding to species divisions based on differential biochemical and physiological tests. Pathogenic strains of *Agrobacterium* share a common feature; they contain at least one large plasmid, the tumor- or root-inducing (Ti and Ri, respectively) plasmid. Virulence is determined by different regions of the plasmid including the transferred DNA (T-DNA) and the virulence (vir) genes. The virulence genes mediate transfer of T-DNA into infected plant cells, where it integrates into the plant DNA. According to the "traditional" classification, Agrobacteria include, but are not limited to, strains of *Agrobacterium tumefaciens*, (which by its natural, "armed" Ti plasmid typically causes crown gall in infected plants), and *Agrobacterium rhizogenes* (which by its natural, "armed" Ri-plasmid causes hairy root disease in infected host plants), *Agrobacterium rubi* (which in its natural, "armed" form causes cane gall on *Rubus*), *Agrobacterium vitis*, and *Agrobacterium radiobacter* (clustering the non-pathogenic Agrobacteria).

Figure 1A:
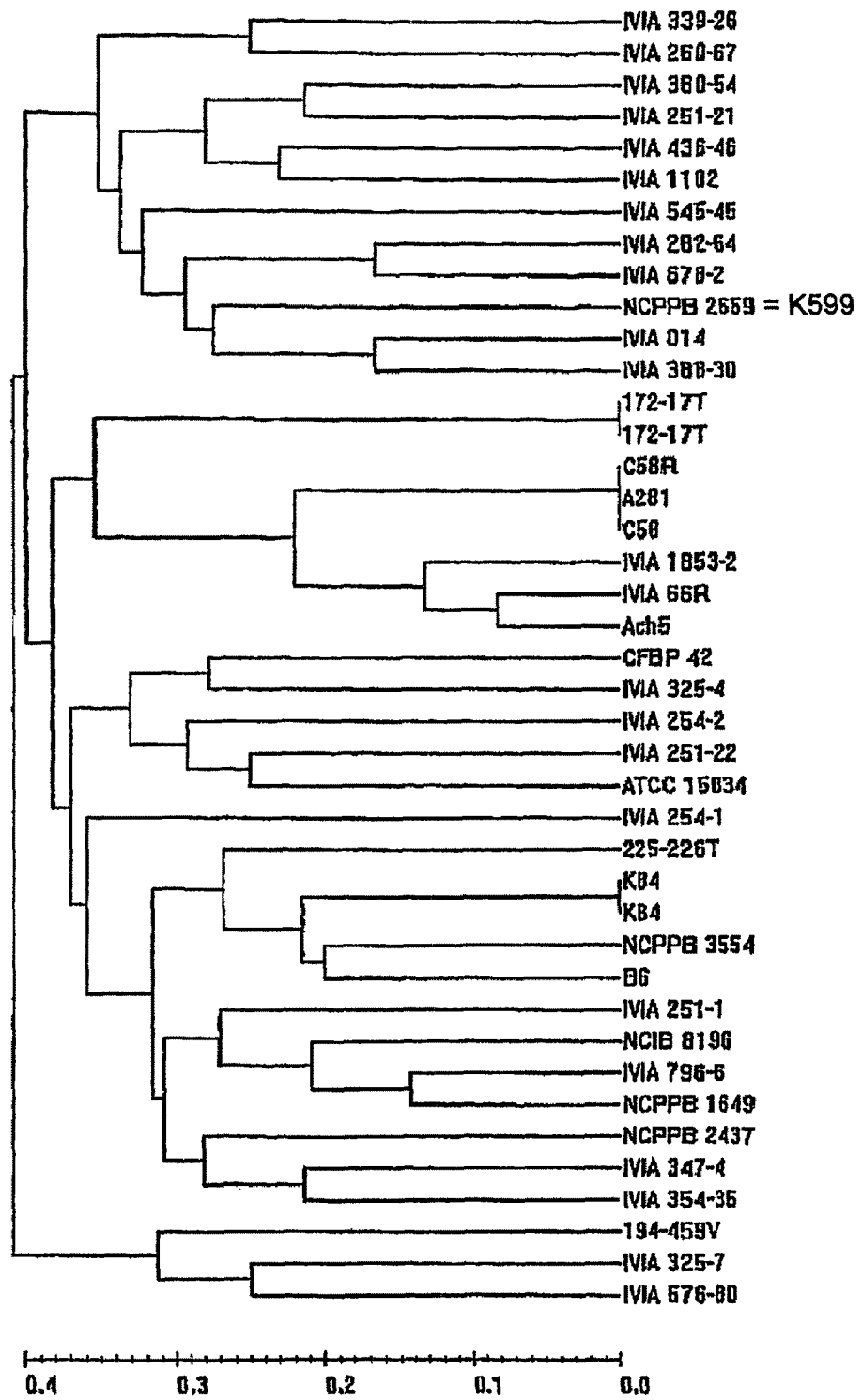
FIG. 1A Dendrogram demonstrating relationship of Agrobacteria strains as determined by RAPD (random-amplified polymorphic DNA) (FIG. 2 from Llob 2003). For description of the various strains see Table 1 below. *Agrobacterium* strain K599 (NCPPB 2659) under this conditions clusters into a distinct group of cultivars separate from traditional "*Agrobacterium tumefaciens*" strains such C58 or Ach5 but also from other "*Agrobacterium rhizogenes*" strains such as NCPPB 8196 or ATCC 15834.
Figure 1B:
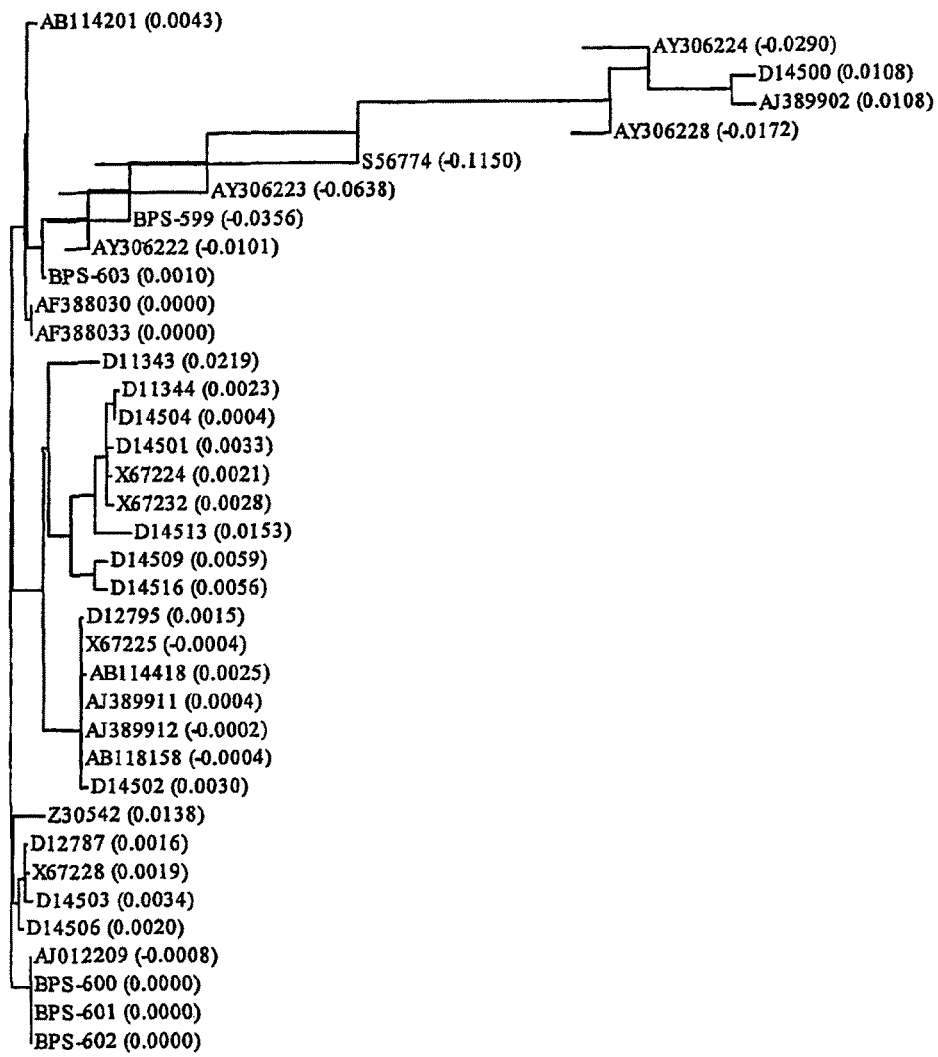
FIG. 1B Dendrogram demonstrating relationship of *Agrobacterium* strains as determined by 16S rRNA comparison. Sequences are compiled using Clustal W program (Saitou 1987). Strains are described by the GenBank Acc.-No. of their respective 16S rRNA. The following strains are assessed.
Figure 1:
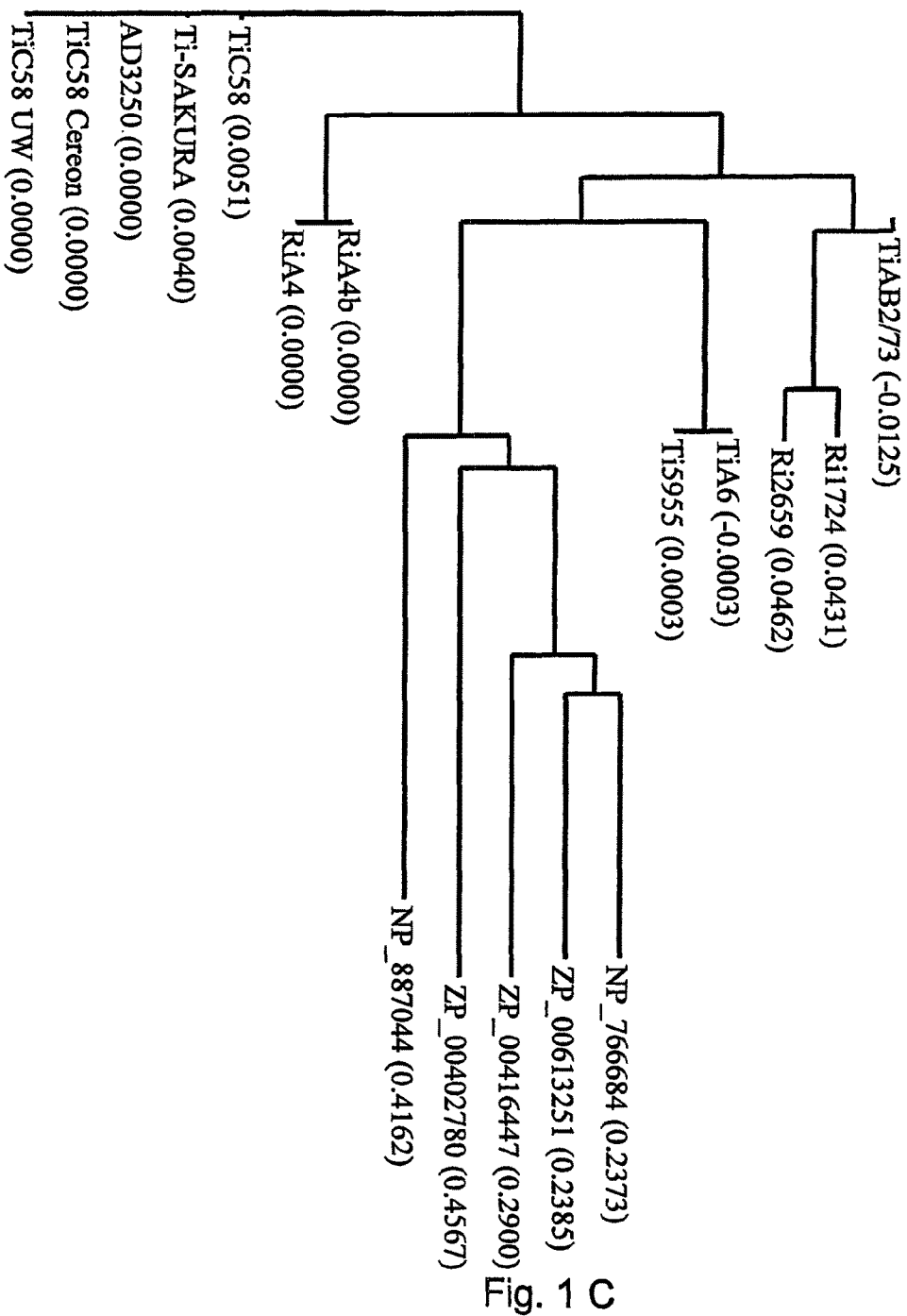

The phylogenetic relationships of members of the genus *Agrobacterium* by two methods demonstrating the relationship of *Agrobacterium* strains K599 are presented in FIG. 1A (based on RAPD (random amplified polymorphic DNA); taken from Llob 2003; FIG. 2) and 1B (based of 16S rRNA sequencing).

TABLE 1

*Agrobacterium* strains (from LIob 2003; Table 1)

| Strain reference | Origin | Biovar | Opine type | Host |
|---|---|---|---|---|
| A281(=C58 with plasmidpTiBo542) | | 1 | Agropine | |

TABLE 1-continued

Agrobacterium strains (from LIob 2003; Table 1)

| Strain reference | Origin | Biovar | Opine type | Host |
|---|---|---|---|---|
| Ach5 | USA | 1 | Octopine | *Prunus* sp. |
| ATCC 15834 | USA | *A. rizhogenes* | ND | Not known |
| B6 | USA | 1 | ND | Not known |
| CFBP 42 | France | 1 | ND | Tomato |
| CFBP 1903 (C58) | USA | 1 | Nopaline | *Prunus cerasus* |
| IVIA 014 | Zaragoza, Spain | 2 | Nopaline | Peach |
| IVIA 66R | Sevilla, Spain | 2 | ND | Rose |
| IVIA 251-1 | Badajoz, Spain | 1 | Nopaline | Almond |
| IVIA 251-21 | Badajoz, Spain | 2 | Nopaline | Cherry |
| IVIA 25 1-22 | Badajoz, Spain | 1 | Nopaline | Cherry |
| IVIA 254-1 | Valencia, Spain | ND | Unknown | Peach |
| IVIA 254-2 | Valencia, Spain | 2 | Nopaline | Peach |
| IVIA 260-67 | Badajoz, Spain | 2 | Nopaline | Poplar |
| IVIA 282-64 | Tenerife, Spain | 2 | Nopaline | Rose |
| IVIA 325-4 | Tarragona, Spain | 1 | Nopaline | Peach x almond |
| IVIA 325-7 | Tarragona, Spain | 2 | Nopaline | Peach x almond |
| IVIA 339-26 | Ourense, Spain | 3 | ND | Grapevine |
| IVIA 347-4 | Valencia, Spain | I | Nopaline | Peach |
| IVIA 354-35 | Valencia, Spain | 2 | Nopaline | Almond |
| IVIA 360-54 | Navarra, Spain | 1 | ND | Grapevine |
| IVIA 388-30 | Zaragoza, Spain | 2 | Nopaline | Almond |
| IVIA 436-46 | Zaragoza, Spain | 1 | Nopaline/mannopine | Peach x almond |
| IVIA 545-45 | Castellon, Spain | 2 | Nopaline | Quince |
| IVIA 576-80 | Cuenca, Spain | 1 | Nopaline | Osier |
| IVIA 678-2 | Valencia, Spain | 1 | ND | Peach x almond |
| IVIA 796-6 | Valencia, Spain | 2 | ND | Peach x almond |
| IVIA 1.102 | Valencia, Spain | 1 | Chrysopine | *Chrysanthemum* |
| IVIA 1853-2 | Zaragoza, Spain | 2 | ND | Peach |
| 172-17T** | Ourense, Spain | I | Octopine | Grapevine |
| 225-226P | Ourense, Spain | 1 | Octopine | Grapevine |
| 194-459Y | Ourense, Spain | 3 | Octopine | Grapevine |
| K84 | Australia. | *A. radioobacter* | Nopaline/octopine | Soil |
| NCIB 8196 | Unknown | *A. rhizogenes* | ND | Not known |
| NCPPB 1649 | South Africa | 2 | ND | Rose |
| NCPPB 2437 | USA | 1 | ND | Not known |
| NCPPB 2659 (K599) | UK | *A. rhizogenes* | Cucumopine | Cucumber |
| NCPPB 3554 | Australia | 3 | ND | Grapevine |

ATCC: American Type Culture Collection, USA;
CFRP: Collection Francaise des Bacteries Phytopatogénes, France;
IVIA: Instituto Valenciano de Investigaciones Agrarias, Spain;
NCIB: National Collection of Industrial Bacteria, UK:
NCPPB: National Collection of Plant Pathogenic Bacteria, UK;
ND: Not determined.

The term Ti-plasmid as used herein is referring to a plasmid which is replicable in *Agrobacterium* and is in its natural, "armed" form mediating crown gall in *Agrobacterium* infected plants. Infection of a plant cell with a natural, "armed" form of a Ti-plasmid of *Agrobacterium* generally results in the production of opines (e.g., nopaline, agropine, octopine etc.) by the infected cell. Thus, *Agrobacterium* strains which cause production of nopaline (e.g., strain LBA4301, C58, A208) are referred to as "nopaline-type" Agrobacteria; *Agrobacterium* strains which cause production of octopine (e.g., strain LBA4404, Ach5, B6) are referred to as "octopine-type" Agrobacteria; and *Agrobacterium* strains which cause production of agropine (e.g., strain EHA105, EHA101, A281) are referred to as "agropine-type" Agrobacteria. A disarmed Ti-plasmid is understood as a Ti-plasmid lacking its crown gall mediating properties but otherwise providing the functions for plant infection. Preferably, the T-DNA region of said "disarmed" plasmid was modified in a way, that beside the border sequences no functional internal Ti-sequences can be transferred into the plant genome. In a preferred embodiment —when used with a binary vector system—the entire T-DNA region (including the T-DNA borders) is deleted.

The term Ri-plasmid as used herein is referring to a plasmid, which is replicable in *Agrobacterium* and is in its natural, "armed" form mediating hairy-root disease in *Agrobacterium* infected plants. Infection of a plant cell with a natural, "armed" form of an Ri-plasmid of *Agrobacterium* generally results in the production of opines (specific amino sugar derivatives produced in transformed plant cells such as e.g., agropine, cucumopine, octopine, mikimopine etc.) by the infected cell. *Agrobacterium rhizogenes* strains are traditionally distinguished into subclasses in the same way *A. tumefaciens* strains are. The most common strains are agropine-type strains (e.g., characterized by the Ri-plasmid pRi-A4), mannopine-type strains (e.g., characterized by the Ri-plasmid pRi8196) and cucumopine-type strains (e.g., characterized by the Ri-plasmid pRi2659). Some other strains are of the mikimopine-type (e.g., characterized by the Ri-plasmid pRi1724). Mikimopine and cucumopine are stereo isomers but no homology was found between the pRi plasmids on the nucleotide level (Suzuki 2001). A disarmed Ri-plasmid is understood as a Ri-plasmid lacking its hairy-root disease mediating properties but otherwise providing the functions for plant infection. Preferably, the T-DNA region of said "disarmed" Ri plasmid was modified in a way, that beside the border sequences no functional internal Ri-sequences can be transferred into the plant genome. In a preferred embodiment—when used with a binary vector system—the entire T-DNA region (including the T-DNA borders) is deleted.

Although Ti and Ri plasmids vary considerably between strains, they all carry similar vir genes.

The term "16S-23S rRNA intergenic sequence" as used herein is intended to mean the genomic DNA region located between the sequences encoding the 16S rRNA and the 23S rRNA. Said intergenic sequence may overlap with the sequences encoding the 16S rRNA and the 23S rRNA.

DETAILED DESCRIPTION OF THE INVENTION

This invention uses "disarmed" strain variants of *Agrobacterium* strain K599 (NCPPB 2659) for T-DNA delivery into plants cells. Hereinafter the previous classification of strain K599 as an "*A. rhizogenes*" strain is not employed, because beside the hairy root inducing phenotype (which is a result of the Ri plasmid but not the bacterial genome) the strain seems to be only remotely related to other *A. rhizogenes* strains based on a comparison analysis of ribosomal rDNA sequences. Thus, the strain is considered to be a unique specimen neither being unambiguously a *A. tumefaciens* or *A. rhizogenes* type of strain.

A first embodiment of the invention relates to a method for producing a transgenic plant cell comprising the steps of:
a) providing bacteria of a transgenic, non-pathogenic strain variant of *Agrobacterium* strain K599 (NCPPB 2659) or of a derivative of said strain, wherein said strain variant is capable to infect plant cells but is lacking hairy root phenotype inducing properties and wherein said strain variant is further comprising a transgenic T-DNA, and
b) co-cultivating a plant cell with said bacteria, and
c) isolating or selecting plant cells comprising stably integrated into their genome said transgenic T-DNA.

Another embodiment of the invention relates to a method for producing a transgenic plant comprising the steps of:
a) providing bacteria of a transgenic, non-pathogenic strain variant of *Agrobacterium* strain K599 (NCPPB 2659) or of a derivative of said strain, wherein said strain variant is capable to infect plant cells but is lacking hairy root phenotype inducing properties and wherein said strain variant is further comprising a transgenic T-DNA, and
b) co-cultivating a plant, plant cell or plant tissue with said bacteria, and
c) isolating or selecting and—optionally—regenerating plants comprising stably integrated into their genome said transgenic T-DNA.

The method of the invention has one or more of the following advantages over the prior art:
a) It is very efficient for transformation of plant species recalcitrant to transformation mediated by the *Agrobacterium tumefaciens* strains known in the art, especially soybeans and trees like poplar and chestnut. Surprisingly, the disarmed derivative of *Agrobacterium rhizogenes* K599 (pRi2659Δ and pRi2659Δtet, respectively) provided herein demonstrate a high infection rate for soybean and provide an improvement over conventional strains of *Agrobacterium* for plant transformation.
b) Because of its vigorous infective properties it can be employed in a concentration much lower than *Agrobacterium tumefaciens*. This allows for target tissues which are very sensitive to normal *Agrobacterium tumefaciens* co-cultivation (such as for example zygotes or immature embryos of plants like wheat).
c) Additionally the T-DNA border from the pRi2659 plasmid is used to create a new binary vector. These border sequences offer an advantage over the conventionally used border sequence, especially in combination with the disarmed strain variant *Agrobacterium rhizogenes* K599 (pRi2659Δ).
d) Finally, the method of the invention is compatible with other *Agrobacterium*-based plant transformation systems.

The methods of the invention can be used to transform virtually all kind of plants. Preferred plants are listed above in the section GENERAL DEFINITION. Preferred are plant cell, plant tissue, or plant derived from a plant selected from the group of monocotyledonous plants, dicotyledonous plants, and gymnosperm plants. More preferably the plant is from a genus selected from the group consisting of *Medicago, Lycopersicon, Brassica, Cucumis, Solanum, Juglans, Gossypium, Malus, Vitis, Antirrhinum, Populus, Fragaria, Arabidopsis, Picea, Capsicum, Chenopodium, Dendranthema, Pharbitis, Pinus, Pisum, Oryza, Zea, Triticum, Triticale, Secale, Lolium, Hordeum, Glycine, Pseudotsuga, Kalanchoe, Beta, Helianthus* and *Nicotiana*.

In a preferred embodiment of the invention the transgenic T-DNA comprises at least one expression cassette for conferring to said plant an agronomically valuable trait or at least one marker gene, which allows for selection and/or identification of transformed plants, plant cells or tissues. Preferred marker genes are described herein below.

1. The "Disarmed" *Agrobacterium* Strain K599 (NCPPB2659)

Another embodiment of the invention is related to a non-pathogenic strain variant of *Agrobacterium* strain K599 (NCPPB 2659) or of a derivative of said strain (hereinafter "disarmed" strain variant), wherein said strain variant is capable to infect plant cells but is lacking hairy root phenotype inducing properties.

The term "derivative" when referring to *Agrobacterium* strain K599 (NCPPB2659) is intended to mean a soil borne, plant pathogenic bacterium, characterized by a 16S-23S rRNA intergenic sequence comprising at least one sequence motif selected from the group consisting of:

```
1.      5'-AATCGTCGATGCGAATTGTTG-3'
        (Motif M1, SEQ ID NO: 5)

2.      5'-GTTTTGTCCTGACGCTGTCGCGA-3'
        (Motif M2, SEQ ID NO: 6)

3.      5'-TCTAACGATCGCTGCGCTCCGGA-3'
        (Motif M3, SEQ ID NO: 7)

4.      5'-CGCCACGAGGCGCGACGGA-3'
        (Motif M4, SEQ ID NO: 8)

5.      5'-TTATGGGCGAATTGATCTGA-3'
        (Motif M5, SEQ ID NO: 9)

6.      5'-GTCCTGCTAAGGATTGATGCCT-3'
        (Motif M6, SEQ ID NO: 10)

7.      5'-AGACCAGTCCTTGTGAAACC-3'
        (Motif M7, SEQ ID NO: 11)
```

```
8.      5'-CCTGGGCATTTTTGTTGTTGG-3'
        (Motif M8, SEQ ID NO: 12)

9.      5'-AATGGTATGGCTTCGAGGTG-3'
        (Motif M9, SEQ ID NO: 13)

10.     5'-CTCAAAGAAGACCGTACCGACA-3'
        (Motif M10, SEQ ID NO: 14)
```

Preferably, the a derivative of *Agrobacterium* strain K599 (NCPPB2659) is characterized by a 16S-23S rRNA intergenic sequence comprising at least two or three motifs, preferably at least four or five motifs, more preferably at least six or seven motifs, most preferably at least eight, nine or ten motifs selected from the group of motifs described by SEQ ID NO: 5, 6, 7, 8, 9, 10, 11, 12, 13, and 14.

Additional characteristic sequence motifs can be identified from the multiple alignment of known 16S-23S rRNA intergenic sequence variable regions (the most similar to *Agrobacterium* K599 are compared in FIG. 14A-E). Preferably, a derivative of *Agrobacterium* K599 is characterized by a 16S-23S rRNA intergenic sequence comprising a sequence with an identity of at least 90%, more preferably at least 95%, most preferably at least 98% with the sequence as described by base pair SEQ ID NO: 20 or the complement thereof. Especially preferred are strains which furthermore are characterized by an 16S rRNA sequence as described by SEQ ID NO: 21.

The non-pathogenic strain variant may further comprising one or more characteristics selected from the group consisting of presence of mutant or chimeric virA or virG genes or presence of super-virulent plasmids. The non-pathogenic strain variant of *Agrobacterium* strain K599 (NCPPB2659) may comprise a non-pathogenic plasmid variant of the pRI2659 plasmid (as defined below).

Another embodiment of the invention is related to a transgenic, non-pathogenic strain variant of *Agrobacterium* strain K599 (NCPPB 2659) or of a derivative of said strain, wherein said strain variant is capable to infect plant cells but is lacking hairy root phenotype inducing properties and wherein said strain variant is further comprising a transgenic T-DNA. In an preferred embodiment of the invention the transgenic T-DNA comprises at least one expression cassette for conferring to said plant an agronomically valuable trait or at least one marker gene, which allows for selection and/or identification of transformed plants, plant cells or tissues. Preferred marker genes are described herein below. Preferred T-DNAs are described herein below.

In a preferred embodiment of the invention, said non-pathogenic strain variant of *Agrobacterium* strain K599 (NCPPB 2659) (or of a derivative of said strain) is capable to infect plant cells, to mediate T-DNA transfer into plant cells, and to mediate T-DNA insertion into the plant genome, but is lacking the hairy root phenotype inducing properties. More preferably, this is achieved by presence of a non-pathogenic plasmid variant of the Ri-plasmid pRi2659 (the natural Ri-plasmid in *Agrobacterium* strain K599; NCPPB 2659) or a derivative thereof (as defined below). Said non-pathogenic plasmid variant preferably provides all functions required for plant cell infection and transformation but is lacking sequences causing the hairy root phenotype. Preferred non-pathogenic plasmid variants of the Ri-plasmid pRi2659 are described herein below.

In another preferred embodiment of the invention, the non-pathogenic *Agrobacterium* strains of the invention are further modified to increase the transformation efficiency, such as by altering vir gene expression and/or induction thereof. This can be realized for example by the presence of mutant or chimeric virA or virG genes (e.g. as described for *Agrobacterium tumefaciens* in Hansen 1994; Chen and Winans 1991; Scheeren-Groot et al., 1994). Possible are further combinations with super-virulent plasmids (e.g., pTOK246-based vectors; Ishida 1996) to generate so-called super-virulent strains. Super-virulent strain variants may also be generated by employing pSB1 super virulence plasmid derived vectors (Komari 1996).

2. The "Disarmed" pRi2659 Plasmid

The isolated sequence of the disarmed version of plasmid pRI2659 is provided herein. This sequence and the sequence information is useful in its entirely but also in part. The plasmid in expressing numerous proteins (see Table 4), of which several are novel over the art and most likely involved in the superior transformation performance of the pRI2659 plasmid. The sequence and sequence information also allow for various uses including but not limited to a) increased understanding of the superior performance of the plasmid,
b) utilization of isolated features (e.g., proteins) from the plasmid to enhance performance of other plant transformation methods (e.g., based on standard *Agrobacterium tumefaciens* based transformations), and
c) directed changes and optimization of said plasmid.

Thus, a preferred embodiment of the invention relates to an isolated nucleotide sequence selected from the group of sequences described by a) sequences comprising a sequence described by SEQ ID NO: 24, or a sequence of at least 100 consecutive nucleotides (preferably at least 250 or 500 consecutive nucleotides, more preferably at least 1000 or 2500 consecutive nucleotides, even more preferably at least 5000 or 10000 consecutive nucleotides, most preferably all consecutive nucleotides) of the sequence described by SEQ ID NO: 24, and b) sequences having a sequence identity of at least 90% (preferably at least 92% or 95%, more preferably at least 97% or 98%, most preferably at least 99%) to a sequence as described by SEQ ID NO: 24 or a sequence of at least 1000 consecutive nucleotides (preferably at least 2000 or 4000 consecutive nucleotides, more preferably at least 5000 or 10000 consecutive nucleotides, even more preferably at least 20000 or 50000 consecutive nucleotides, most preferably all consecutive nucleotides) of the sequence described by SEQ ID NO: 24, and, c) sequences hybridizing under conditions equivalent to binding or hybridization at 68° C. in a solution consisting of 5× SSPE, 1% SDS, 5× Denhardt's reagent and 100 µg/mL denatured salmon sperm DNA followed by washing in a solution comprising 0.1× SSPE, and 0.1% SDS at 68° C. to a probe consisting of at least 100 consecutive nucleotides (preferably at least 250 or 500 consecutive nucleotides, more preferably at least 1000 or 2500 consecutive nucleotides, even more preferably at least 5000 or 10000 consecutive nucleotides, most preferably all consecutive nucleotides) of a sequences as described by SEQ ID NO: 24 or the complementary sequence thereto.

Another embodiment of the invention is related to a non-pathogenic ("disarmed") plasmid variant of pRi2659 (the natural Ri-plasmid in *Agrobacterium* strain K599; NCPPB 2659) or a derivative thereof, said plasmid variant providing the functions required for plant cell infection and transformation, but lacking sequences causing the hairy root phenotype (hereinafter "disarmed" plasmid variant). Preferably, said non-pathogenic plasmid variant is comprising the sequences required for plant cell infection and transformation of the native, pathogenic pRi2659 or its derivative but is lacking sequences of the T-DNA mediating the hairy root phenotype.

Preferably the non-pathogenic plasmid variant of pRi2659 or of its derivative is comprising no elements (such as for example T-DNA elements) which can be transferred into the plant genome. This is especially advantageous when combined with a transgenic T-DNA comprised in a binary vector. There are various means to provide such a "disarmed" plasmid variant. By way of example this may be realized by:
1. Rendering the borders of the T-DNA dysfunctional (e.g., by mutagenesis) or
2. Deleting the entire T-DNA from the Ri plasmid, or
3. Screening for natural deletion or non-pathogenic mutant, or
4. Deletion mutagenesis (e.g., employing acetosyringone) by inducing DNA nicks and excision of the T-DNA, or
5. Transposon mutagenesis and screening for a non-pathogenic mutants or
6. Directed and specific deletion of relevant genes using e.g., gene replacement strategy. By replacing the wild type copies of genes between the RB and LB with a deleted replacement, one is able to exactly excise only the genes that need to be deleted.

In one especially preferred embodiment of the invention said non-pathogenic plasmid variant is comprising at least one sequence selected from the group of sequences described by
a) sequences comprising a sequence described by SEQ ID NO: 24, or a sequence of at least 100 consecutive nucleotides (preferably at least 250 or 500 consecutive nucleotides, more preferably at least 1000 or 2500 consecutive nucleotides, even more preferably at least 5000 or 10000 consecutive nucleotides, most preferably all consecutive nucleotides) of the sequence described by SEQ ID NO: 24, and
b) sequences having a sequence identity of at least 90% (preferably at least 92% or 95%, more preferably at least 97% or 98%, most preferably at least 99%) to a sequence as described by SEQ ID NO: 24 or a sequence of at least 1000 consecutive nucleotides (preferably at least 2000 or 4000 consecutive nucleotides, more preferably at least 5000 or 10000 consecutive nucleotides, even more preferably at least 20000 or 50000 consecutive nucleotides, most preferably all consecutive nucleotides) of the sequence described by SEQ ID NO: 24, and,
c) sequences hybridizing under conditions equivalent to binding or hybridization at 68° C. in a solution consisting of 5× SSPE, 1% SDS, 5× Denhardt's reagent and 100 µg/mL denatured salmon sperm DNA followed by washing in a solution comprising 0.1× SSPE, and 0.1% SDS at 68° C. to a probe consisting of at least 100 consecutive nucleotides (preferably at least 250 or 500 consecutive nucleotides, more preferably at least 1000 or 2500 consecutive nucleotides, even more preferably at least 5000 or 10000 consecutive nucleotides, most preferably all consecutive nucleotides) of a sequences as described by SEQ ID NO: 24 or the complementary sequence thereto.

More preferably, said non-pathogenic plasmid variant is described by a nucleotide sequence describing the disarmed pRi2659 plasmid or a derivative above (as defined above). Even more preferably or alternatively, the derivative is encoding a virD2 protein having a amino acid sequence identify of at least 85% (preferably at least 90% or 92%, more preferably at least 95% or 98%, most preferably at least 99%) with the sequence described by SEQ ID NO 112.

Said virD2 protein is expected to be a key factor for the enhanced performance in transformation of the disarmed pRi2659 plasmid. Thus another embodiment of the invention relates to a polypeptide comprising an amino acid sequence selected from the group consisting of:
a) the sequence as described by SEQ ID NO: 112 or sequences of at least 200 consecutive amino acids (preferably at least 300 consecutive amino acids, more preferably at least 400 consecutive amino acids, preferably all consecutive amino acids) thereof,
b) sequences having an sequence identity of at least 85% (preferably at least 90% or 92%, more preferably at least 95% or 98%, most preferably at least 99%) with the sequences described by SEQ ID NO: 112.

However, also the other proteins encoded by the disarmed pRI2659 plasmid are considered to be useful for optimization of transformation processes, thus another embodiment of the invention relates to a polypeptide comprising an amino acid sequence selected from the group consisting of:
a) the sequence as described by any of SEQ ID NO: 25, 26, 27, 28, 29, 30, 31, 32, 33, 34, 35, 36, 37, 38, 39, 40, 41, 42, 43, 44, 45, 46, 47, 48, 49, 50, 51, 52, 53, 54, 55, 56, 57, 58, 59, 60, 61, 62, 63, 64, 65, 66, 67, 68, 69, 70, 71, 72, 73, 74, 75, 76, 77, 78, 79, 80, 81, 82, 83, 84, 85, 86, 87, 88, 89, 90, 91, 92, 93, 94, 95, 96, 97, 98, 99, 100, 101, 102, 103, 104, 114, 115, 116, 117, 118, 119, 120, 121, 122, 123, 124, 126, 128, 129, 130, 131, 132, 133, 134, 136, 137, 139, 140, 142, 143, 144, 145, 146, 147, 148, 149, 150, 151, 152, 154, 155, 156, 158, 159, 161, 162, 163, 164, 165, 166, 167, 168, 169, 170, 171, 172, 173, 174, 175, 176, 177, 178, 179, 180, 181, 182, 183, 184, 185, 186, or 187 or sequences of at least 200 consecutive amino acids (preferably at least 300 consecutive amino acids, more preferably at least 400 consecutive amino acids, preferably all consecutive amino acids) thereof,
b) sequences having an sequence identity of at least 85% (preferably at least 90% or 92%, more preferably at least 95% or 98%, most preferably at least 99%) with a sequence described by any of SEQ ID NO: 25, 26, 27, 28, 29, 30, 31, 32, 33, 34, 35, 36, 37, 38, 39, 40, 41, 42, 43, 44, 45, 46, 47, 48, 49, 50, 51, 52, 53, 54, 55, 56, 57, 58, 59, 60, 61, 62, 63, 64, 65, 66, 67, 68, 69, 70, 71, 72, 73, 74, 75, 76, 77, 78, 79, 80, 81, 82, 83, 84, 85, 86, 87, 88, 89, 90, 91, 92, 93, 94, 95, 96, 97, 98, 99, 100, 101, 102, 103, 104, 114, 115, 116, 117, 118, 119, 120, 121, 122, 123, 124, 126, 128, 129, 130, 131, 132, 133, 134, 136, 137, 139, 140, 142, 143, 144, 145, 146, 147, 148, 149, 150, 151, 152, 154, 155, 156, 158, 159, 161, 162, 163, 164, 165, 166, 167, 168, 169, 170, 171, 172, 173, 174, 175, 176, 177, 178, 179, 180, 181, 182, 183, 184, 185, 186, or 187.

Still another embodiment of the invention relates to isolated nucleic acid sequences encoding said polypeptides. These sequences may be the isolated natural sequences (as comprised in the pRI2659 plasmid) or other sequences derived based on the degeneration of the genetic code.

Most preferably these derived sequences of the virD2 protein provided therein are comprising at least one unique amino acid residue of the virD2 protein as specified in FIG. 16 (by the asterixes (*)).

Preferably, the non-pathogenic plasmid variant is obtained by deleting the entire T-DNA including the borders from the native plasmid. More preferably, for the non-pathogenic plasmid variant of the invention the deleted T-DNA corresponds to the sequence described by the sequence from about base 538 to about base 15,519 of SEQ ID NO: 4 or from about base 3644 to about 18577 base of SEQ ID NO: 26.

Preferably, the entire T-DNA is deleted from the Ri plasmid (more preferably including the entire right and left border). Deletion of the entire T-DNA including the entire RB and LB from the Ri plasmid (e.g. pRi2659) is preferred, since in past cases of disarmed Ti plasmids where a portion of either border was left intact on the Ti plasmid, there was the possibility of integration of DNA behind this border and from the binary plasmid. The method employed in the preferred embodiment of this invention eliminates the possibility of extraneous DNA integration. Accordingly, an preferred embodiment of the invention relates to a non-pathogenic plasmid variant of pRi2659 or a derivative thereof, wherein said plasmid variant is comprising the sequences required for plant cell infection and transformation of the native, pathogenic pRi2659 or its derivative but is lacking the T-DNA, preferably the region described by the sequence from about base 538 to about base 15,519 of the sequence characterized by GenBank Acc.-No. AJ271050 (SEQ ID NO: 4) or from about base 3644 to about 18577 base of the sequence characterized by SEQ ID NO: 26. This sequence corresponds to the T-DNA of the original, pathogenic Ri-plasmid pRi2659 as provided in the pathogenic *Agrobacterium* strain K599 (NCPPB 2659). More preferably said non-pathogenic plasmid variant is comprising under high-stringency conditions (e.g., equivalent to binding or hybridization at 68° C. in a solution consisting of 5× SSPE, 1% SDS, 5× Denhardt's reagent and 100 µg/mL denatured salmon sperm DNA followed by washing in a solution comprising 0.1× SSPE, and 0.1% SDS at 68° C.) with the original (native), pathogenic Ri-plasmid pRi2659 as provided in the pathogenic *Agrobacterium* strain K599 (NCPPB 2659), but not hybridizing under said high-stringency conditions with the sequence from about base 538 to about base 15,519 of the sequence characterized by GenBank Acc.-No. AJ271050 (SEQ ID NO: 4) or from about base 3644 to about 18577 base of the sequence characterized by SEQ ID NO: 26.

More preferably, the derivative of pRi2659 is a plasmid able to mediate T-DNA transfer from a soil borne bacterium into a plant cell further characterized by
a) having a sequence identity of at least 90% (preferably at least 91% or 92%, more preferably at least 95% or 98%, most preferably at least 99%) with the DNA encoding the native pRi2659 plasmid (as comprised in *Agrobacterium* strain K599 (NCPPB2659) or
b) hybridizing under high stringency conditions (e.g., equivalent to binding or hybridization at 68° C. in a solution consisting of 5× SSPE, 1% SDS, 5× Denhardt's reagent and 100 µg/mL denatured salmon sperm DNA followed by washing in a solution comprising 0.1× SSPE, and 0.1% SDS at 68° C.) with the native pRi2659 plasmid (as described by SEQ ID NO: 111).

In an preferred embodiment the non-pathogenic plasmid variant of the invention hybridizes under high-stringency conditions with the entire, native, pathogenic Ri-plasmid pRi2659 of the pathogenic *Agrobacterium* strain K599 (NCPPB 2659), but does not hybridize under high-stringency conditions with the sequence from about base 538 to about base 15,519 of the sequence characterized by SEQ ID NO: 4 or from about base 3644 to about 18577 base of the sequence characterized by SEQ ID NO: 26.

The term "derivative" when referring to pRi2659 is intended to mean a plasmid able to mediate T-DNA transfer from a soil borne bacterium into a plant cell further characterized by
a) having a sequence identity of at least 90%, more preferably at least 95%, most preferably at least 98% with the DNA encoding the native pRi2659 plasmid (as comprised in *Agrobacterium* strain K599 (NCPPB2659) or
b) hybridizing under high stringency conditions (as defined above) with the native pRi2659 plasmid.

More preferably, such derivative of pRi2659 in its natural, pathogenic form is mediating a cucumopine-type phenotype of opine synthesis.
3. The Transgenic T-DNA Preferably, the T-DNA in said transgenic, non-pathogenic strain variant of *Agrobacterium* strain K599 (NCPPB 2659) or its derivative is comprised on a binary vector plasmid separate from the plasmid providing the features required for plant infection (such as a Ti- or Ri-plasmid lacking their neoplastic or hairy-root inducing properties). Thus, another embodiment of the invention relates to a transgenic T-DNA flanked by at least one T-DNA border from the *Agrobacterium rhizogenes* pRi2659 plasmid, said transgenic T-DNA comprising no sequences causing a hairy root phenotype.

Preferably the T-DNA is flanked by at least the right border sequence (more preferably by the right and the left border sequence). Preferred are Ti- and/or Ri borders. T-DNA border are repeats of about 25 bp, well defined as described in the art (Zupan 2000). By combined action of the so-called vir genes (part of the original Ti or Ri-plasmids) the borders mediate T-DNA transfer.

In an preferred embodiment said transgenic T-DNA is comprising at least one expression cassette for conferring to said plant an agronomically valuable trait. In another preferred embodiment said T-DNA is further comprising at least one marker gene, which allows for selection and/or identification of transformed plants, plant cells or tissues.

The T-DNA borders of plasmid pRI2659 has been demonstrated to be especially efficient in T-DNA transfer and thus in generating transgenic plants (especially transgenic soybean plants). Thus, preferably, the T-DNA comprises the T-DNA borders from the pRi2659 plasmid (e.g., incorporated into a binary vector). The right border has 16 repeats of an 8 bp sequence that is functionally equivalent to an overdrive (Hansen 1992). These border sequences offer an advantage over the conventionally used border sequence. Especially preferred is a combination of the disarmed strain variant or derivative of *Agrobacterium* strain K599 (BCPPB2659) with a transgenic T-DNA comprising the borders of a Ri-plasmid, more preferably the pRi2659 plasmid, which combination contributes to a high transformation efficiency e.g., for soybean. Especially preferred are left border sequences comprising a sequence described by SEQ ID NO: 18 representing base 538 to 561 of SEQ ID NO: 4 (T-DNA region of pRi2659):

5'-tggcaggata tattgtggtg taaa-3' (SEQ ID NO: 18)

Especially preferred are right border sequences comprising a sequence described by SEQ ID NO: 19 representing base 15,496 to 15,519 of SEQ ID NO: 4 (T-DNA region of pRi2659):

5'-tgacaggata tatccccttg tcta-3' (SEQ ID NO: 19)

Thus, another embodiment of the invention relates to a plasmid vector comprising a transgenic T-DNA flanked by at least one T-DNA border from the *Agrobacterium rhizogenes* pRi2659 plasmid. Preferably, these borders are described by SEQ ID NO: 18 or 19. More preferably, the plasmid is comprising the right border comprising a sequence as described by SEQ ID NO: 19. Most preferably, the plasmid is comprising both border sequences, comprising a sequence as described by SEQ ID NO: 18 and 19, respectively. Preferably, said plasmid is comprising no sequences causing a hairy root phenotype, more preferably said plasmid is comprising no internal T-DNA protein-encoding sequences, most preferably said plasmid is comprising substantially no internal T-DNA sequences. The term "internal" in this context means the DNA flanked by (but excluding the T-DNA borders). The T-DNA borders are understood as sequences at least comprising the sequences as described by SEQ ID NO: 18 and 19, respectively. The term "substantially" is intended to mean that some internal sequences which are not linked to a pathogenic phenotype may be included, preferably these sequences are not more than 200 base pairs, preferably not more than 100 base pairs, most preferably not more than 50 base pairs, and are preferably directly consecutive to the border sequences.

The T-DNA to be incorporated into the plant genome by means of the non-pathogenic strain variant can be provided in various forms. The T-DNA can be provided as a DNA construct, preferably integrated into specific plasmids, either into a shuttle, or intermediate, vector or into a binary vector. Provision may occur for example (but not limited) by the following means:

a) The T-DNA may be incorporated in the chromosomal DNA of the non-pathogenic strain variant.
b) The T-DNA may be incorporated in the disarmed Ri-plasmid DNA comprised in the non-pathogenic strain variant.
c) The T-DNA may be comprised in the non-pathogenic strain variant in form of plasmid separate from the disarmed Ri plasmid.

Preferably, the T-DNA in said non-pathogenic strain variant is comprised on a binary vector plasmid separate from the disarmed Ri plasmid.

In another preferred embodiment said T-DNA is further comprising at least one marker gene, which allows for selection and/or identification of transformed plants, plant cells or tissues.

Other embodiments of the invention relate to cells or non-human organisms comprising a nucleotide sequence, a non-pathogenic plasmid variant, or a transgenic T-DNA of the invention. Preferably, said cells or non-human organisms ere selected from the group consisting of bacteria, yeasts, plants, mammals, and insects. In one preferred embodiment said cell or organism is a soil born bacterium of the genus *Rhizobiaceae*. In another preferred embodiment said cell or organism is plant cell or plant organism, more preferably selected from the group of monocotyledonous and dicotyledonous plants. Most preferred are plants selected from the group consisting of soybean, corn (maize), wheat, rape seed (canola), tagetes, potato, rice, barley, and tomato.

Another embodiment of the present invention relates to a transgenic vector comprising a transgenic T-DNA of the invention. Preferably, the T-DNA is provided in form of a binary vector. In the so-called "binary vector systems", the T-DNA is physically separated from the other functional elements of the Ri-plasmid (e.g., the vir genes), by being incorporated into a shuttle vector, which allowed easier handling (for description of Ti-plasmid based binary systems see EP-A 120 516; U.S. Pat. No. 4,940,838). These binary vectors comprise (besides the disarmed T-DNA with its border sequences), prokaryotic sequences for replication both in *Agrobacterium* and *E. coli*. In present case the disarmed *Agrobacterium rhizogenes* strain employed for the transformation comprises, in addition to its disarmed Ri plasmid, a binary plasmid with the T-DNA to be transferred, which, preferably, comprises a gene for the selection of the transformed *Agrobacterium* cells (generally outside of the T-DNA), a marker for selection of transformed plant cells, and the nucleic acid sequence of interest to be transferred (the later two generally comprised within the T-DNA). The binary plasmid can be transferred into the disarmed *Agrobacterium rhizogenes* strain for example by electroporation or other transformation methods (Mozo 1991). Binary vectors are capable of replication both in *E. coli* and in *Agrobacterium*. They can be transformed directly into Agrobacteria (e.g., as described Holsters 1978). The *Agrobacterium*, which acts as host organism in this case, should already contain a plasmid with the vir region. The latter is required for transferring the T-DNA to the plant cell. An *Agrobacterium* thus transformed can be used for transforming plant cells. A selection marker allowing for selection of transformed Agrobacteria is, for example, the nptI or nptII gene conferring resistance against Kanamycin, or the aadA gene conferring resistance against streptomycin, spectinomycin. Various markers (selection marker and reporter genes) are suitable for identification and/or selection or transformed plant cells, tissues or plants (see below for details). Descriptions of *Agrobacterium* vector systems and methods for *Agrobacterium*-mediated transformation are known in the art (Miki 1993; Gruber 1993; Moloney 1989). Various binary vectors are known, some of which are commercially available such as, for example, pBIN19 (Clontech Laboratories, Inc. USA). All vectors suitable for transformation based on *Agrobacterium tumefaciens* can also be employed for the method of the invention. Common binary vectors are based on "broad host range"-plasmids like pRK252 (Bevan 1984) or pTJS75 (Watson 1985) derived from the P-type plasmid RK2. Most of these vectors are derivatives of pBIN19 (Bevan 1984). Various binary vectors are known, some of which are commercially available such as, for example, pBI101.2 or pBIN19 (Clontech Laboratories, Inc. USA). Additional vectors were improved with regard to size and handling (e.g. pPZP; Hajdukiewicz 1994). Improved vector systems are described also in WO 02/00900. A binary vector or any other vector can be modified by common DNA recombination techniques, multiplied in *E. coli*, and introduced into *Agrobacterium* by e.g., electroporation or other transformation techniques (Mozo 1991).

Thus, another embodiment of the invention related to a cell or non-human organism comprising a non-pathogenic plasmid variant of the invention (as specified above) or a transgenic T-DNA or vector comprising said T-DNA of the invention. Preferably, said cell or non-human organism is selected from the group consisting of bacteria, yeasts, plants, mammals, and insects. More preferably, said cell or non-human organism is a soil born bacterium of the genus *Rhizobiaceae*. Especially preferred are soil born bacteria such as *Sinorhizobium meliloti, Sinorhizobium medicae, Sinorhizobium fredii, Rhizobium* sp. NGR234, *Rhizobium* sp. BR816, *Rhizobium* sp. N33, *Rhizobium* sp. GRH2, *Sinorhizobium saheli, Sinorhizobium terangae, Rhizobium leguminosarum* biovar *trffolii, Rhizobium leguminosarum* biovar *viciae, Rhizobium leguminosarum* biovar *phaseoli, Rhizobium tropici, Rhizobium etli, Rhizobium galegae, Rhizobium gallicum, Rhizobium giardinii, Rhizobium hainanense, Rhizobium mongolense, Rhizobium lupini, Mesorhizobium loti, Mesorhizobium huakuii, Mesorhizobium ciceri, Mesorhizobium mediterraneium, Mesorhizobium tianshanense, Bradyrhizobium elkanni, Bradyrhizobium japonicum, Bradyrhizobium liaoningense, Azorhizobium caulinodans, Allobacterium undicola, Phyllobacterium myrsinacearum, Agrobacterium tumefaciens, Agrobacterium radiobacter, Agrobacterium rhizogenes, Agrobacterium vitis*, and *Agrobacterium rubi*.

In a preferred embodiment of the invention the T-DNA to be integrated into the plant genome by means of the disarmed *Agrobacterium rhizogenes* strain of the invention, comprising at least one expression cassette for conferring to said plant an agronomically valuable trait. In another preferred embodiment said T-DNA is further comprising at least one marker gene, which allows for selection and/or identification of transformed plants, plant cells or tissues. Thus, the T-DNA inserted into the genome of the target plant comprises at least one expression cassette, which may—for example—facilitate expression of selection marker gene, trait genes, antisense RNA or double-stranded RNA. Preferably said expression cassettes comprise a promoter sequence functional in plant cells operatively linked to a nucleic acid sequence which—upon expression —confers an advantageous phenotype to the so transformed plant. The person skilled in the art is aware of numerous sequences which may be utilized in this context, e.g. to increase quality of food and feed, to produce chemicals, fine chemicals or pharmaceuticals (e.g., vitamins, oils, carbohydrates; Dunwell 2000), conferring resistance to herbicides, or conferring male sterility. Furthermore, growth, yield, and resistance against abiotic and biotic stress factors (like e.g., fungi, viruses or insects) may be enhanced. Advantageous properties may be conferred either by overexpressing proteins or by decreasing expression of endogenous proteins by e.g., expressing a corresponding antisense (Sheehy 1988; U.S. Pat. No. 4,801,340; Mol 1990) or double-stranded RNA (Matzke 2000; Fire 1998; Waterhouse 1998; WO 99/32619; WO 99/53050; WO 00/68374; WO 00/44914; WO 00/44895; WO 00/49035; WO 00/63364).

For expression in plants, plant-specific promoters are preferred. The term "plant-specific promoter" is understood as meaning, in principle, any promoter which is capable of governing the expression of genes, in particular foreign genes, in plants or plant parts, plant cells, plant tissues or plant cultures. In this context, expression can be, for example, constitutive, inducible or development-dependent (as defined and specified above).

The genetic component and/or the expression cassette may comprise further genetic control sequences in addition to a promoter. The term "genetic control sequences" is to be understood in the broad sense and refers to all those sequences which affect the making or function of the DNA construct to the invention or an expression cassette comprised therein. For example, genetic control sequences modify the transcription and translation in prokaryotic or eukaryotic organisms. Preferably, the expression cassettes according to the invention encompass a promoter functional in plants 5'-upstream of the nucleic acid sequence in question to be expressed recombinantly, and 3'-downstream a terminator sequence as additional genetic control sequence and, if appropriate, further customary regulatory elements, in each case linked operably to the nucleic acid sequence to be expressed recombinantly.

Genetic control sequences are described, for example, in "Goeddel; Gene Expression Technology: Methods in Enzymology 185, Academic Press, San Diego, Calif. (1990)" or "Gruber and Crosby, in: Methods in Plant Molecular Biology and Biotechnology, CRC Press, Boca Raton, Fla., eds.: Glick and Thompson, Chapter 7, 89-108" and the references cited therein.

Examples of such control sequences are sequences to which inductors or repressors bind and thus regulate the expression of the nucleic acid. Genetic control sequences furthermore also encompass the 5'-untranslated region, introns or the non-coding 3'-region of genes, such as, for example, the actin-1 intron, or the Adh1-S introns 1, 2 and 6 (general reference: The Maize Handbook, Chapter 116, Freeling and Walbot, Eds., Springer, New York (1994)). It has been demonstrated that they may play a significant role in the regulation of gene expression. Thus, it has been demonstrated that 5'-untranslated sequences are capable of enhancing the transient expression of heterologous genes. Examples of translation enhancers which may be mentioned are the tobacco mosaic virus 5'-leader sequence (Gallie 1987) and the like. Furthermore, they may promote tissue specificity (Rouster 1998). Furthermore, they may promote tissue specificity (Rouster 1998). Conversely, the 5'-untranslated region of the opaque-2 gene suppresses expression. Deletion of the region in question leads to an increased gene activity (Lohmer 1993). Genetic control sequences may also encompass ribosome-binding sequences for initiating translation. This is preferred in particular when the nucleic acid sequence to be expressed does not provide suitable sequences or when they are not compatible with the expression system.

The expression cassette may advantageously comprise one or more enhancer sequences, linked operably to the promoter, which make possible an increased recombinant expression of the nucleic acid sequence. Additional advantageous sequences, such as further regulatory elements or terminators, may also be inserted at the 3'-end of the nucleic acid sequences to be expressed recombinantly. Polyadenylation signals which are suitable as control sequences are plant polyadenylation signals, preferably those which essentially correspond to T-DNA polyadenylation signals from *Agrobacterium tumefaciens*, in particular the octopine synthase (OCS) terminator and the nopaline synthase (NOS) terminator.

One or more copies of the nucleic acid sequences to be expressed recombinantly may be present in the gene construct. Genetic control sequences are furthermore understood as meaning sequences which encode fusion proteins consisting of a signal peptide sequence.

Control sequences are furthermore to be understood as those permitting removal of the inserted sequences from the genome. Methods based on the cre/lox (Sauer B 1998; Odell 1990; Dale 1991), FLP/FRT (Lysnik 1993), or Ac/Ds system (Wader 1987; U.S. Pat. No. 5,225,341; Baker 1987; Lawson 1994) permit a—if appropriate tissue-specific and/or inducible—removal of a specific DNA sequence from the genome of the host organism. Control sequences may in this context mean the specific flanking sequences (e.g., lox sequences), which later allow removal (e.g., by means of cre recombinase).

The genetic component and/or expression cassette of the invention may comprise further functional elements. The term functional element is to be understood in the broad sense and refers to all those elements which have an effect on the generation, amplification or function of the genetic component, expression cassettes or recombinant organisms according to the invention. Functional elements may include for example (but shall not be limited to):

1. Selectable Marker Genes

Selectable marker genes are useful to select and separate successfully transformed or homologous recombined cells. Preferably, within the method of the invention one marker may be employed for selection in a prokaryotic host, while another marker may be employed for selection in a eukaryotic host, particularly the plant species host. The markers may be protection against a biocide, such as antibiotics, toxins, heavy metals, or the like, or may function by complementation, imparting prototrophy to an auxotrophic host. Preferred selectable marker genes for plants may include but are not be limited to the following:

1.1 Negative Selection Markers

Negative selection markers confer a resistance to a biocidal compound such as a metabolic inhibitor (e.g., 2-deoxyglucose-6-phosphate, WO 98/45456), antibiotics (e.g., kanamycin, G 418, bleomycin or hygromycin) or herbicides (e.g., phosphinothricin or glyphosate). Especially preferred negative selection markers are those which confer resistance to herbicides. Examples which may be mentioned are:

- Phosphinothricin acetyltransferases (PAT; also named Bialophos resistance; bar; De Block 1987; EP 0 333 033; U.S. Pat. No. 4,975,374)
- 5-enolpyruvylshikimate-3-phosphate synthase (EPSPS; U.S. Pat. No. 5,633,435) or glyphosate oxidoreductase gene (U.S. Pat. No. 5,463,175) conferring resistance to Glyphosate (N-phosphonomethyl glycine) (Shah 1986)
- Glyphosate degrading enzymes (Glyphosate oxidoreductase; gox),
- Dalapon inactivating dehalogenases (deh)
- Sulfonylurea- and imidazolinone-inactivating acetolactate synthases (for example mutated ALS variants with, for example, the S4 and/or Hra mutation
- Bromoxynil degrading nitrilases (bxn)
- Kanamycin- or. G418-resistance genes (NPTII; NPTI coding e.g., for neomycin phos-photransferases (Fraley 1983), which expresses an enzyme conferring resistance to the antibiotic kanamycin and the related antibiotics neomycin, paromomycin, gentamicin, and G418,
- 2-Deoxyglucose-6-phosphate phosphatase (DOGR1-Gene product; WO 98/45456; EP 0 807 836) conferring resistance against 2-desoxyglucose (Randez-Gil 1995)
- Hygromycin phosphotransferase (HPT), which mediates resistance to hygromycin (Vanden Elzen 1985).
- Dihydrofolate reductase (Eichholtz 1987)

Additional negative selectable marker genes of bacterial origin that confer resistance to antibiotics include the aadA gene, which confers resistance to the antibiotic spectinomycin, gentamycin acetyl transferase, streptomycin phosphotransferase (SPT), aminoglycoside-3-adenyl transferase and the bleomycin resistance determinant (Hayford 1988; Jones 1987; Svab 1990; Hille 1986).

Especially preferred are negative selection markers which confer resistance against the toxic effects imposed by D-amino acids like e.g., D-alanine and D-serine (WO 03/060133). Especially preferred as negative selection marker in this contest are the daoI gene (EC: 1.4. 3.3: GenBank Acc.-No.: U60066) from the yeast *Rhodotorula gracilis* (*Rhodosporidium toruloides*) and the *E. coli* gene dsdA (D-serine dehydratase (D-serine deaminase) (EC: 4.3. 1.18; GenBank Acc.-No.: J01603).

1.2) Positive Selection Marker

Positive selection markers are conferring a growth advantage to a transformed plant in comparison with a non-transformed one. Genes like isopentenyltransferase from *Agrobacterium tumefaciens* (strain:PO22; Genbank Acc.-No.: AB025109) may—as a key enzyme of the cytokinin biosynthesis—facilitate regeneration of transformed plants (e.g., by selection on cytokinin-free medium). Corresponding selection methods are described (Ebinuma 2000a,b). Additional positive selection markers, which confer a growth advantage to a transformed plant in comparison with a non-transformed one, are described e.g., in EP-A 0 601 092. Growth stimulation selection markers may include (but shall not be limited to) β-Glucuronidase (in combination with e.g., cytokinin glucuronide), mannose-6-phosphate isomerase (in combination with mannose), UDP-galactose-4-epimerase (in combination with e.g., galactose), wherein mannose-6-phosphate isomerase in combination with mannose is especially preferred.

1.2) Counter Selection Marker

Counter selection markers are especially suitable to select organisms with defined deleted sequences comprising said marker (Koprek 1999). Examples for negative selection marker comprise thymidine kinases (TK), cytosine deaminases (Gleave 1999; Perera 1993; Stougaard 1993), cytochrom P450 proteins (Koprek 1999), haloalkan dehalogenases (Naested 1999), iaaH gene products (Sundaresan 1995), cytosine deaminase codA (Schlaman & Hooykaas 1997), or tms2 gene products (Fedoroff & Smith 1993).

2) Reporter Genes

Reporter genes encode readily quantifiable proteins and, via their color or enzyme activity, make possible an assessment of the transformation efficacy, the site of expression or the time of expression. Very especially preferred in this context are genes encoding reporter proteins (Schenborn 1999) such as the green fluorescent protein (GFP) (Sheen 1995; Haseloff 1997; Reichel 1996; Tian 1997; WO 97/41228; Chui 1996; Leffel 1997), chloramphenicol transferase, a luciferase (Ow 1986; Millar 1992), the aequorin gene (Prasher 1985), β-galactosidase, R locus gene (encoding a protein which regulates the production of anthocyanin pigments (red coloring) in plant tissue and thus makes possible the direct analysis of the promoter activity without addition of further auxiliary substances or chromogenic substrates (Dellaporta 1988; Ludwig 1990), with β-glucuronidase (GUS) being very especially preferred (Jefferson 1987a,b). β-glucuronidase (GUS) expression is detected by a blue color on incubation of the tissue with 5-bromo-4-chloro-3-indolyl-β-D-glucuronic acid, bacterial luciferase (LUX) expression is detected by light emission; firefly luciferase (LUC) expression is detected by light emission after incubation with luciferin; and galactosidase expression is detected by a bright blue color after the tissue was stained with 5-bromo-4-chloro-3-indolyl-β-D-galactopyranoside. Reporter genes may also be used as scorable markers as alternatives to antibiotic resistance markers. Such markers are used to detect the presence or to measure the level of expression of the transferred gene. The use of scorable markers in plants to identify or tag genetically modified cells works well only when efficiency of modification of the cell is high.

3) Origins of replication, which ensure amplification of the expression cassettes or vectors according to the invention in, for example, *E. coli*. Examples which may be mentioned are ORI (origin of DNA replication), the pBR322 ori or the P15A ori (Maniatis 1989). Additional examples for replication systems functional in *E. coli*, are ColE1, pSC101, pACYC184, or the like. In addition to or in place of the *E. coli* replication system, a broad host range replication system may be employed, such as the replication systems of the P-1 Incompatibility plasmids; e.g., pRK290. These plasmids are particularly effective with armed and disarmed Ti-plasmids for transfer of T-DNA to the plant host.

4) Elements which are necessary for *Agrobacterium*-mediated transformation, such as, for example, the right and/or—optionally—left border of the T-DNA or the vir region.

5) Multiple cloning sites (MCS) to enable and facilitate the insertion of one or more nucleic acid sequences.

Typically, constructs comprising a T-DNA (or any other DNA construct employed within the scope of the present invention) are prepared using transgene expression techniques. Recombinant expression techniques involve the construction of recombinant nucleic acids and the expression of genes in transfected cells. Molecular cloning techniques to achieve these ends are known in the art. A wide variety of cloning and in vitro amplification methods suitable for the construction of recombinant nucleic acids are well-known to persons of skill. Examples of these techniques and instructions sufficient to direct persons of skill through many cloning exercises are found in Berger and Kimmel (1987), Maniatis 1989, Silhavy 1984, Ausubel 1998). Preferably, the DNA construct according to the invention is generated by joining the abovementioned essential constituents of the DNA construct together in the abovementioned sequence using the recombination and cloning techniques with which the skilled worker is familiar.

The construction of polynucleotide constructs generally requires the use of vectors able to replicate in bacteria. A plethora of kits are commercially available for the purification of plasmids from bacteria. For their proper use, follow the manufacturer's instructions (see, for example, EasyPrep™, FlexiPrep™, both from Pharmacia Biotech; StrataClean™, from Stratagene; and, QIAexpress™ Expression System, Qiagen). The isolated and purified plasmids can then be further manipulated to produce other plasmids, used to transfect cells or incorporated into *Agrobacterium tumefaciens* to infect and transform plants. Where *Agrobacterium* is the means of transformation, shuttle vectors are constructed.

4. The Transformation Procedure

The methods of the invention are useful for obtaining transgenic plants, or cells, parts, tissues, harvested material derived therefrom.

Accordingly, another subject matter of the invention relates to transgenic plants or plant cells comprising in their genome, preferably in their nuclear, chromosomal DNA, the DNA construct according to the invention (e.g., the T-DNA comprising the borders of the Ri plasmid pRi2659), and to cells, cell cultures, tissues, parts or propagation material—such as, for example, in the case of plant organisms leaves, roots, seeds, fruit, pollen and the like—derived from such plants. Other important aspects of the invention include the progeny of the transgenic plants prepared by the disclosed methods, as well as the cells derived from such progeny, and the seeds obtained from such progeny.

Plant varieties may be excluded, particularly registrable plant varieties according to Plant Breeders Rights. It is noted that a plant need not be considered a "plant variety" simply because it contains stably within its genome a transgene, introduced into a cell of the plant or an ancestor thereof. In addition to a plant, the present invention provides any clone of such a plant, seed, selfed or hybrid progeny and descendants, and any part or propagule of any of these, such as cuttings and seed, which may be used in reproduction or propagation, sexual or asexual. Also encompassed by the invention is a plant which is a sexually or asexually propagated off-spring, clone or descendant of such a plant, or any part or propagule of said plant, off-spring, clone or descendant. Genetically modified plants according to the invention which can be consumed by humans or animals can also be used as food or feedstuffs, for example directly or following processing known in the art.

The method of the invention can virtually be employed on all plants varieties, including varieties of monocotyledonous and dicotyledonous plants (as defined and specified above).

Surprisingly, the disarmed *Agrobacterium rhizogenes* strain of the invention resulted in high transformation efficiency for monocotyledonous plants like e.g., corn (*Zea mays*). There are various methods for monocotyledonous plant transformation. Particle bombardment is often favored, because of its efficiency and no host range limitation (Christou 1995; Jahne 1995). However, the irregular structure and number of transformation events (e.g., multiple or fragmented copies) requires screening and detailed analysis of a high number of the resulting transgenics (Hadi 1996; Trick 1997). On the other hand, establishment of a system for transformation of monocotyledonous plants mediated by *Agrobacterium* had been considered difficult, since infection of monocotyledonous plants by *Agrobacterium* is a very rare event and reasonable efficiency could only be achieved using 'super-virulent' *A. tumefaciens* strains and/or acetosyringone, a phenolic compound inducing expression of vir genes on the Ti-plasmid (Belamino 2000; Eady 2000; Hiei 1994; Smith and Hood 1995; Wilmink 1992). However, there are no reports prior to the present invention of transformation of monocots mediated by a disarmed *A. rhizogenes* strain.

Also numerous explants, plant tissues, or plant cell culture may be employed as target material for the co-cultivation process. One of skill will recognize that after DNA construct is stably incorporated in transgenic plants and confirmed to be operable, it can be introduced into other plants by sexual crossing. Any of a number of standard breeding techniques can be used, depending upon the species to be crossed.

To transfer the DNA to the plant cell, plant explants are co-cultured with the disarmed *Agrobacterium rhizogenes* of the invention comprising the transgenic T-DNA. Starting from Infected plant material (for example leaf, root or stalk sections, but also protoplasts or suspensions of plant cells), intact plants can be regenerated using a suitable medium which may contain, for example, antibiotics or biocides for selecting transformed cells. The plants obtained can then be screened in the presence of the DNA introduced, in this case the DNA construct according to the invention. As soon as the DNA has integrated into the host genome, the genotype in question is, as a rule, stable and the insertion in question is also found in the subsequent generations. Preferably the stably transformed plant is selected utilizing a selection marker comprised in the transgenic T-DNA. The plants obtained can be cultured and hybridized in the customary fashion. Two or more generations should be grown in order to ensure that the genomic integration is stable and hereditary.

Various tissues are suitable as starting material (explant) for the *Agrobacterium*-mediated transformation process including but not limited to callus (U.S. Pat. No. 5,591,616; EP-A1 604 662), immature embryos (EP-A1 672 752), pollen (U.S. Pat. No. 5,929,300), shoot apex (U.S. Pat. No. 5,164,310), or in planta transformation (U.S. Pat. No. 5,994,624). The method and material described herein can be combined with virtually all *Agrobacterium* mediated transformation methods known in the art. Preferred combinations include—but are not limited—to the following starting materials and methods:

| Variety | Material/Citation |
| --- | --- |
| Monocotyledonous plants: | Immature embryos (EP-A1 672 752) |
| | Callus (EP-A1 604 662) |
| | Embryogenic callus (U.S. Pat. No. 6,074,877) |

| Variety | Material/Citation |
|---|---|
| | Inflorescence (U.S. Pat. No. 6,037,522) |
| | Flower (in planta) (WO 01/12828) |
| Banana | U.S. Pat. No. 5,792,935; EP-A1 731 632; U.S. Pat. No. 6,133,035 |
| Barley | WO 99/04618 |
| Maize | U.S. Pat. No. 5,177,010; U.S. Pat. No. 5,987,840 |
| Pineapple | U.S. Pat. No. 5,952,543; WO 01/33943 |
| Rice | EP-A1 897 013; U.S. Pat. No. 6,215,051; WO 01/12828 |
| Wheat | AU-B 738 153; EP-A1 856 060 |
| Beans | U.S. Pat. No. 5,169,770; EP-A1 397 687 |
| Brassica | U.S. Pat. No. 5,188,958; EP-A1 270 615; EP-A1 1,009,845 |
| Cacao | U.S. Pat. No. 6,150,587 |
| Citrus | U.S. Pat. No. 6,103,955 |
| Coffee | AU 729 635 |
| Cotton | U.S. Pat. No. 5,004,863; EP-A1 270 355; U.S. Pat. No. 5,846,797; EP-A1 1,183,377; EP-A1 1,050,334; EP-A1 1,197,579; EP-A1 1,159,436 |
| | Pollen transformation (U.S. Pat. No. 5,929,300) |
| | In planta transformation (U.S. Pat. No. 5,994,624) |
| Pea | U.S. Pat. No. 5,286,635 |
| Pepper | U.S. Pat. No. 5,262,316 |
| Poplar | U.S. Pat. No. 4,795,855 |
| Soybean | cotyledonary node of germinated soybean seedlings |
| | shoot apex (U.S. Pat. No. 5,164,310) |
| | axillary meristematic tissue of primary, or higher leaf node of about 7 days germinated soybean seedlings |
| | organogenic callus cultures |
| | dehydrated embryo axes |
| | U.S. Pat. No. 5,376,543; EP-A1 397 687; U.S. Pat. No. 5,416,011; U.S. Pat. No. 5,968,830; U.S. Pat. No. 5,563,055; U.S. Pat. No. 5,959,179; EP-A1 652 965; EP-A1 1,141,346 |
| Sugarbeet | EP-A1 517 833; WO 01/42480 |
| Tomato | U.S. Pat. No. 5,565,347 |

Efficiency of transformation with *Agrobacterium* can be enhanced by numerous other methods known in the art like for example wounding, vacuum infiltration (WO 00/58484), heat shock and/or centrifugation, addition of silver nitrate, sonication etc. In a preferred embodiment of the invention, the explant material is wounded prior to inoculation (co-cultivation) with *Agrobacterium*. Many methods of wounding can be used, including, for example, cutting, abrading, piercing, poking, penetration with fine particles or pressurized fluids, plasma wounding, application of hyperbaric pressure, or sonication. Wounding can be performed using objects such as, but not limited to, scalpels, scissors, needles, abrasive objects, airbrush, particles, electric gene guns, or sound waves. Another alternative is vacuum infiltration (EP-A1 1,141,356; EP-A1 1,171,618). Other methods to increase *Agrobacterium* transformation efficiency can known in the art can be combined, including but not limited to sonication (EP-A1 904,362) or weight reduction of the target tissue (EP-A1 1,137,790).

The disarmed Agrobacteria *rhizogenes* bacteria of the invention are grown and used in a manner as known in the art. The vector comprising *Agrobacterium* strain may, for example, be grown for 3 days on YEB medium (see Example 2.6) supplemented with the appropriate antibiotic (e.g., 50 mg/L spectinomycin). Bacteria are collected with a loop from the solid medium and resuspended. In a preferred embodiment of the invention, *Agrobacterium* cultures are started by use of aliquots frozen at −80° C. For *Agrobacterium* treatment of isolated petioles, the bacteria are resuspended in the medium used for petiole culture.

The concentration of *Agrobacterium* used for infection and co-cultivation may need to be varied. Thus, a range of *Agrobacterium* concentrations from $10^5$ to $10^{10}$ cfu/mL and a range of co-cultivation periods from a few hours to 7 days can be used. The co-cultivation of *Agrobacterium* with the isolated petioles is in general carried out for 1 to 5, preferably 2 to 4 days.

The explants are then inoculated with the *Agrobacterium* culture for a few minutes to a few hours, typically about 10 minutes to 3 hours, preferably about 0.5 hours to 1 hour. The excess media is drained and the *Agrobacterium* are permitted to co-cultivate with the target tissue for several days, typically three days in the dark. During this step, the *Agrobacterium* transfers the foreign genetic construct into some cells of the target tissue. Normally no selection agent presents during this step.

It is possible, although not necessary, to employ one or more phenolic compounds in the medium prior to or during the *Agrobacterium* co-cultivation. "plant phenolic compounds" or "plant phenolics" suitable within the scope of the invention are those isolated substituted phenolic molecules which are capable to induce a positive chemotactic response, particularly those who are capable to in-duce increased vir gene expression in a Ri-plasmid containing *Agrobacterium* sp. Preferred is acetosyringone. Moreover, certain compounds, such as osmoprotectants (e.g. L-proline preferably at a concentration of about 700 mg/L or betaine), phytohormones (inter alia NAA), opines, or sugars, are expected to act synergistically when added in combination with plant phenolic compounds. The plant phenolic compound, particularly acetosyringone, can be added to the medium prior to contacting the isolated petioles with Agrobacteria (for e.g., several hours to one day). Possible concentrations of plant phenolic compounds in the medium range from about 25 μM to 700 μM. However, for the methods of the invention preferably no acetosyringone is employed. Particularly suited induction conditions for *Agrobacterium tumefaciens* have been described by Vernade et al. (1988).

Supplementation of the co-cultivation medium with antioxidants (e.g., dithiothreitol), or thiol compounds (e.g., L-cysteine, Olhoft 2001) which can decrease tissue necrosis due to plant defense responses (like phenolic oxidation) may further improve the efficiency of *Agrobacterium*-mediated transformation.

After co-cultivation steps can be included to remove, suppress growth or kill the *Agrobacterium rhizogenes*. This steps may include one or mode washing steps. The medium employed after the co-cultivation step preferably contains a bacteriocide (antibiotic). This step is intended to terminate or at least retard the growth of the non-transformed cells and kill the remaining *Agrobacterium* cells. Preferred antibiotics to be employed are e.g., carbenicillin (500 mg/L) or Timentin™ (GlaxoSmithKline; a mixture of ticarcillin disodium and clavulanate potassium; 0.8 g Timentin™ contains 50 mg clavulanic acid with 750 mg ticarcillin. Chemically, ticarcillin disodium is N-(2-Carboxy-3,3-dimethyl-7-oxo-4-thia-1-azabicyclo[3.2.0]hept-6-yl)-3-thio-phenemalonamic acid disodium salt. Chemically, clavulanate potassium is potassium (Z)-(2R, 5R)-3-(2-hydroxyethylidene)-7-oxo-4-oxa-1-azabicyclo[3.2.0]heptane-2-carboxylate).

After the co-cultivation step the co-cultivated explants are preferably incubated on a regeneration medium comprising at least one plant growth factor. The employed media may further contain at least one compound, which in combination with the selectable marker gene allows for identification and/or selection of plant cells (e.g., a selective agent) may be applied. However, it is preferred that explants are incubated for a certain time, preferably 5 to 14 days, after the co-cultivation step on medium lacking a selection compound. Establishment of a reliable resistance level against said selection compound needs some time to prevent unintended damage by the selection compound even to the transformer cells and tissue.

Transformed cells, i.e. those which comprise the DNA integrated into the DNA of the host cell, can be selected from untransformed cells preferably using the selection method of the invention. As soon as a transformed plant cell has been generated, an intact plant can be obtained using methods known to the skilled worker. For example, callus cultures are used as starting material. The formation of shoot and root can be induced in this as yet undifferentiated cell biomass in the known fashion. The shoots obtained can be planted and cultured.

*Agrobacterium*-mediated techniques typically may result in gene delivery into a limited number of cells in the targeted tissue. Therefore, in a preferred embodiment of the invention, a selective agent is applied post-transformation to kill all of the cells in the targeted tissues that are not transformed or to identify transformed cells through a selective advantage. The length of culture depends, in part, on the toxicity of the selection agent to untransformed cells. The selectable marker gene and the corresponding selection compound used for said selection or screening can be any of a variety of well-known selection compounds, such as antibiotics, herbicides, or D-amino acids (see below for details). The length of this culture step is variable (depending on the selection compound and its concentration, the selectable marker gene), extending from one day to 120 days. Insertion of a selectable and/or screenable marker gene is comprised within the scope of the method of the invention. This may be advantageous e.g., for later use as a herbicide-resistance trait.

For example, with the kanamycin resistance gene (neomycin phosphotransferase, NPTII as the selective marker, kanamycin at a concentration of from about 3 to 200 mg/L may be included in the medium. Typical concentrations for selection are 5 to 50 mg/L. The tissue is grown upon this medium for a period of 1 to 3 weeks, preferably about 7 days until shoots have developed.

For example, with the phosphinotricin resistance gene (bar) as the selective marker, phosphinotricin at a concentration of from about 3 to 200 mg/L may be included in the medium. Typical concentrations for selection are 5 to 50 mg/L. The tissue is grown upon this medium for a period of 1 to 3 weeks, preferably about 7 days until shoots have developed.

For example, with the dao1 gene as the selective marker, D-serine or D-alanine at a concentration of from about 3 to 100 mg/L may be included in the medium. Typical concentrations for selection are 20 to 40 mg/L. The tissue is grown upon this medium for a period of 1 to 3 weeks, preferably about 7 days until shoots have developed.

Transformed plant cells, derived by any of the above transformation techniques, can be cultured to regenerate a whole plant which possesses the transformed genotype and thus the desired phenotype. Such regeneration techniques rely on manipulation of certain phytohormones in a tissue culture growth medium, typically relying on a biocide and/or herbicide marker that has been introduced together with the desired nucleotide sequences. Plant regeneration from cultured protoplasts is described (Evans 1983; Binding, 1985). Regeneration can also be obtained from plant callus, explants, somatic embryos (Dandekar 1989; McGranahan 1990), organs, or parts thereof. Such regeneration techniques are described (generally in Klee 1987). Other available regeneration techniques are described (Vasil 1984; Weissbach 1989).

The media as employed during the method of the invention for regeneration and/or selection may be optionally further supplemented with one or more plant growth regulator, like e.g., cytokinin compounds (e.g., 6-benzylaminopurine) and/or auxin compounds (e.g., 2,4-D). The term "plant growth regulator" (PGR) as used herein means naturally occurring or synthetic (not naturally occurring) compounds that can regulate plant growth and development. PGRs may act singly or in consort with one another or with other com-pounds (e.g., sugars, amino acids). The term "auxin" or "auxin compounds" comprises compounds which stimulate cellular elongation and division, differentiation of vascular tissue, fruit development, formation of adventitious roots, production of ethylene, and—in high concentrations—induce dedifferentiation (callus formation). The most common naturally occurring auxin is indoleacetic acid (IAA), which is transported polarly in roots and stems. Synthetic auxins are used extensively in modern agriculture. Auxin compounds comprise indole-3-butyric acid (IBA), naphthylacetic acid (NAA), and 2,4-dichlorphenoxyacetic acid (2,4-D). Compounds that induce shoot formation include, but not limited to, IAA, NAA, IBA, cytokinins, auxins, kinetins, glyphosate, and thiadiazorun.

The term "cytokinin" or "cytokinin compound" comprises compounds which stimulate cellular division, expansion of cotyledons, and growth of lateral buds. They delay senescence of detached leaves and, in combination with auxins (e.g. IAA), may influence formation of roots and shoots. Cytokinin compounds comprise, for example, 6-isopentenyladenine (IPA) and 6-benzyladenine/6-benzylaminopurine (BAP).

Descendants can be generated by sexual or non-sexual propagation. Non-sexual propagation can be realized by introduction of somatic embryogenesis by techniques well known in the art. Preferably, descendants are generated by sexual propagation/fertilization. Fertilization can be realized either by selfing (self-pollination) or crossing with other transgenic or non-transgenic plants. The transgenic plant of the Invention can herein function either as maternal or paternal plant. Descendants may comprise one or more copies of the agronomically valuable trait gene. Preferably, descendants are isolated which only comprise one copy of said trait gene.

All of the compositions and methods disclosed and claimed herein can be made and executed without undue experimentation in light of the present disclosure. While the compositions and methods of this invention have been described in terms of preferred embodiments, it will be apparent to those of skill in the art that variations may be applied to the composition, methods and in the steps or in the sequence of steps of the method described herein without departing from the concept, spirit and scope of the invention. More specifically, it will be apparent that certain agents which are both chemically and physiologically related may be substituted for the agents described herein while the same or similar results would be achieved. All such similar substitutes and modifications apparent to those skilled in the art are deemed to be within the spirit, scope and concept of the invention as defined by the appended claims. All publications and patent applications mentioned in this specification are indicative of the level of skill of those skilled in the art to which this invention pertains. All publications and patent applications are herein incorporated by reference to the same extent as if each individual publication or patent application was specifically and individually indicated to be incorporated by reference. Certain aspects and embodiments of the invention will now be illustrated by way of example and with reference to the figure described below.

Sequences
1. SEQ ID NO: 1: Nucleic acid sequence encoding right flank sequence of pRI2659
2. SEQ ID NO: 2: Nucleic acid sequence encoding left flank sequence of pRI2659
3. SEQ ID NO: 3: Nucleic acid sequence of cloning vector pRL278 (GenBank Acc.-No.: L05083)
4. SEQ ID NO: 4: Nucleic acid sequence encoding T-DNA region of pRI2659 (Gen-Bank Acc.-No. AJ271050).
5. SEQ ID NO: 5: *Agrobacterium* strain K599 16S-23S rRNA intergenic sequence motif M1: 5'-AATCGTCGATGC-GAATTGTTG-3'
6. SEQ ID NO: 6: *Agrobacterium* strain K599 16S-23S rRNA intergenic sequence motif M2: 5'-GTTTTGTCCT-GACGCTGTCGCGA-3'
7. SEQ ID NO: 7: *Agrobacterium* strain K599 16S-23S rRNA intergenic sequence motif M3: 5'-TCTAACGATCGCT-GCGCTCCGGA-3'
8. SEQ ID NO: 8: *Agrobacterium* strain K599 16S-23S rRNA intergenic sequence motif M4: 5'-CGCCACGAGGCGC-GACGGA-3'
9. SEQ ID NO: 9: *Agrobacterium* strain K599 16S-23S rRNA intergenic sequence motif M5: 5'-TTATGGGCGAAT-TGATCTGA-3'
10. SEQ ID NO: 10 *Agrobacterium* strain K599 16S-23S rRNA intergenic sequence motif M6: 5'-GTCCT-GCTAAGGATTGATGCCT-3'
11. SEQ ID NO: 11 *Agrobacterium* strain K599 16S-23S rRNA intergenic sequence motif M7: 5'-AGACCAGTC-CTTGTGAAACC-3'
12. SEQ ID NO: 12 *Agrobacterium* strain K599 16S-23S rRNA intergenic sequence motif M8: 5'-CCTGGGCATTTTGTTGTTGTGG-3'
13. SEQ ID NO: 13 *Agrobacterium* strain K599 16S-23S rRNA intergenic sequence motif M9: 5'-AATGGTATG-GCTTCGAGGTG-3'
14. SEQ ID NO: 14 *Agrobacterium* strain K599 16S-23S rRNA intergenic sequence motif M10: 5'-CTCAAAGAA-GACCGTACCGACA-3'
15. SEQ ID NO: 15 Binary vector pBPSEW008 [p-NOS::c-bar::t-NOS p-PcUBI::c-gusINT::t-NOS]
16. SEQ ID NO: 16 Binary vector pBPSMM192b [p-AtAhas::c-csr1-2::t-AtAHAS t-NOS::c-gusINT::p-SUPER]
17. SEQ ID NO: 17 JT-Binary vector pBPSMM232 [p-ZmUbi1::c-ZmAHASL/Xi12::t-ZmAHAS t-NOS::cgusINT::p-ZmUbi1]
   pBPSMM232 is a vector which is as such is not replicable in *Agrobacterium* but only in *E. coli*. Transformation into *Agrobacterium* comprising super-binary plasmid pSB1 results in a chimeric plasmid (pSB1/pBPSMM232) by selection-mediated fusion between pBPSMM232 and pSB1; Komari 1996)
18. SEQ ID NO: 18 Left border sequence of pRi2659 5-TGGCAGGATA TATTGTGGTG TAAA-3'
19. SEQ ID NO: 19 Right border sequence of pRi2659 5'-TGACAGGATA TATCCCCTTG TCTA-3'
20. SEQ ID NO: 20 16S-23S rRNA intergenic sequence of *Agrobacterium* strain K599
21. SEQ ID NO: 21 Genomic DNA encoding 16S rRNA of *Agrobacterium* strain K599
22. SEQ ID NO: 22 Deletion vector pBPSSH009
23. SEQ ID NO: 23 Deletion vector pRL278 LF/RF (also named pBPSSH009b)
24. SEQ ID NO: 24 Nucleic acid sequence encoding pRI2659Δ (not comprising tetracyclin selection marker (tet))
25. SEQ ID NO: 25: Amino acid sequence encoded by rcorf1, similar to mll6374-like, integrase/recombinase [*Mesorhizobium loti* MAFF303099]
26. SEQ ID NO: 26 Amino acid sequence encoded by rcorf13, weakly similar to riorf22 in pRi1724, similar to hypothetical protein Bcep02000337 [*Burkholderia fungorum* LB400]
27. SEQ ID NO: 27 Amino acid sequence encoded by rcorf14, probable cucumbopine transporter gene, similar to riorf37 in pRi1724, a probable mikimopine transporter
28. SEQ ID NO: 28: Amino acid sequence encoded by rcorf16, similar to SMa2205 *Sinorhizobium meliloti* 1021 (strain: 1021), a COG1176 [E] ABC-type spermidine/putrescine transport system, permease component I
29. SEQ ID NO: 29 Amino acid sequence encoded by rcorf19, similar to hutI, imidazolone-5-propionate hydrolase [*Agrobacterium tumefaciens* str. C58], less similar to riorf39 in pRi1724, KEGG pathway: Histidine metabolism 00340.
30. SEQ ID NO: 30 Amino acid sequence encoded by rcorf20, similar to riorf41 in pRi1724, a hypothetical protein
31. SEQ ID NO: 31 Amino acid sequence encoded by rcorf21, similar to riorf42 in pRi1724, a hutU gene homolog, a urocanase, EC number 4.2.1.49
32. SEQ ID NO: 32 Amino acid sequence encoded by rcorf22, similar to protein of unknown function DUF886 [*Mesorhizobium* sp. BNC1] and less similar to riorf43 in pRi1724, similar to unknown gene next to hutR gene in *Pseudomonas putida*
33. SEQ ID NO: 33 Amino acid sequence encoded by rcorf23, similar C-term similar to IS30 family transposase
34. SEQ ID NO: 34 Amino acid sequence encoded by rcorf32, similar to riorf60 in pRi1724, similar to gatA-1 gene [Glutamyl-tRNA amidotransferase, subunit A (gatA-1) *Sulfolobus solfataricus* P2]
35. SEQ ID NO: 35 Amino acid sequence encoded by rcorf34, similar to riorf62 in pRi1724, hypothetical ABC-transporter gene similar to agaB gene, agropinic acid permease, pfam00528: BPD_transp_1; Binding-protein-dependent transport system inner membrane component 36. SEQ ID NO: 36 Amino acid sequence encoded by rcorf35, similar to riorf63 in pRi1724, hypothetical ABC-transporter gene similar to dppC gene, pfam00528: BPD_transp_1; Binding-protein-dependent transport system inner membrane component 37. SEQ ID NO: 37 Amino acid sequence encoded by rcorf36, similar to riorf64 in pRi1724, hypothetical ABC-transporter gene similar to moaD gene, mannopinic acid permease, COG1123: ATPase components of various ABC-type transport systems.

38. SEQ ID NO: 38 Amino acid sequence encoded by rcorf37, similar to riorf66 in pRi1724, similar to amaB gene, N-carbamoyl-beta-alanine amido-hydrolase 39. SEQ ID NO: 39 Amino acid sequence encoded by rcorf39, similar to riorf68 in pRi1724, weakly similar to pck gene, pfam01633: Choline_kinase; Choline/ethanolamine kinase 40. SEQ ID NO: 40 Amino acid sequence encoded by rcorf40, similar to riorf69 in pRi1724, similar to MLCB1779.29 (probable monophosphatase gene) in *Mycobacterium leprae*, cd01641: Bacterial_IMPase_like_1; Predominantly bacterial family of Mg++ dependend phosphatases, related to inositol monophosphatases 41. SEQ ID NO: 41 Amino acid sequence encoded by rcorf41, similar to riorf71 in pRi1724, hypothetical chemoreceptor gene similar to orf2 gene in pTi15955

42. SEQ ID NO: 42 Amino acid sequence encoded by rcorf44, similar to riorf74, similar to teuB (periplasmic sugar binding protein) gene, COG1879: RbsB; ABC-type sugar transport system, periplasmic component [Carbohydrate transport and metabolism].

43. SEQ ID NO: 43 Amino acid sequence encoded by rcorf45, similar to riorf75 in pRi1724, similar to teuA (ATP-binding sugar ABC transporter) gene, hypothetical ABC-transporter gene, COG1129: MglA; ABC-type sugar transport system, ATPase component [Carbohydrate transport and metabolism].

44. SEQ ID NO: 44 Amino acid sequence encoded by rcorf46, similar to riorf76 in pRi1724, similar to teuC1 (sugar ABC transporter-permease) gene, a hypothetical ABC-transporter gene, pfam02653: BPD_transp_2; Branched-chain amino acid transport system/permease component.

45. SEQ ID NO: 45 Amino acid sequence encoded by rcorf47, similar to riorf77 in pRi1724, similar to teuC2 (sugar ABC transporter-permease) gene, a hypothetical ABC-transporter gene, pfam02653: BPD_transp_2; Branched-chain amino acid transport system/permease component.

46. SEQ ID NO: 46 Amino acid sequence encoded by rcorf48, similar to riorf78 in pRi1724, a COG2755 [E] Lysophospholipase L1 and related esterases.

47. SEQ ID NO: 47 Amino acid sequence encoded by rcorf50, similar to riorf80 of pRi1724, a glpD gene homolog, glycerol-3-phosphate dehydrogenase [*Agrobacterium tumefaciens* str. C58]

48. SEQ ID NO: 48 Amino acid sequence encoded by rcorf51, similar to riorf81 in pRi1724, a acs(acetyl-CoA synthetase) gene homolog, EC 6.2.1.1.

49. SEQ ID NO: 49 Amino acid sequence encoded by rcorf52, similar to riorf82 of pRi1724, a adk gene homolog, pfam00406: ADK; Adenylate kinase, EC 2.7.4.3.

50. SEQ ID NO: 50 Amino acid sequence encoded by rcorf53, similar to riorf83 in pRi1724, a hypothetical chemoreceptor gene similar to orf2 gene in pTi15955

51. SEQ ID NO: 51 Amino acid sequence encoded by rcorf54, similar to riorf84, a cbbF gene homolog, a cd00354: FBPase; Fructose-1,6-bisphosphatase, an enzyme that catalyzes the hydrolysis of fructose-1,6-biphosphate into fructose-6-phosphate and is critical in gluconeogenesis pathway.

52. SEQ ID NO: 52 Amino acid sequence encoded by rcorf55, cbbA gene homolog, a cd00947: TBP_aldolase_IIB; Tagatose-1,6-bisphosphate (TBP) aldolase and related Type B Class II aldolases 53. SEQ ID NO: 53 Amino acid sequence encoded by rcorf56, similar to pdb Chain A, Yeast Triosephosphate Isomerase (tri1)

54. SEQ ID NO: 54 Amino acid sequence encoded by rcorf57, similar to riorf88 in pRi1724 and to phrR gene, DNA binding protein, helix-turn-helix XRE family.

55. SEQ ID NO: 55 Amino acid sequence encoded by rcorf58, similar to riorf89 in pRi1724 and to thcR gene, conserved domain, HTH_ARAC; helix_turn_helix, arabinose operon control protein 56. SEQ ID NO: 56 Amino acid sequence encoded by rcorf59, similar to riorf90 in pRi1724 and Atu6096 in pTiC58, conserved in *Mesorhizobium* and *Agrobacterium* species.

57. SEQ ID NO: 57 Amino acid sequence encoded by rcorf60, similar to riorf91 in pRI1724, also similar to several hypothetical proteins in *Agrobacterium, Mesorhizobium* and *Nitrobacter* species.

58. SEQ ID NO: 58 Amino acid sequence encoded by rcorf61, similar to riorf92 in pRi1724, hypothetical protein conserved in several *Agrobacterium* and *Mesorhizobium* strains.

59. SEQ ID NO: 59 Amino acid sequence encoded by rcorf62, similar to riorf93, similar to jhp0928 gene in *Helicobacter pylori*, a COG0827; Adenine-specific DNA methylase [DNA replication, recombination, and repair].

60. SEQ ID NO: 60 Amino acid sequence encoded by rcorf63, similar to AGR_pTi_191 partitioning protein *Agrobacterium tumefaciens* str. C58, partitioning protein, COG1475 [K] Predicted transcriptional regulators.

61. SEQ ID NO: 61 Amino acid sequence encoded by rcorf64, similar to hypothetical protein MesoDRAFT_1041 [*Mesorhizobium* sp. BNC1], conserved in *Agrobacterium, Mesorhizobium*, and *Nitrobacter* species.

62. SEQ ID NO: 62 Amino acid sequence encoded by rcorf66, similar to hypothetical protein MesoDRAFT_1043 [*Mesorhizobium* sp. BNC1], conserved in *Agrobacterium, Mesorhizobium*, and *Nitrobacter* species.

63. SEQ ID NO: 63 Amino acid sequence encoded by rcorf67, similar to riorf96 in pRi1724, a hypothetical protein weakly similar to downstream region of hydL gene in *Thiocapsa roseopersicina*.

64. SEQ ID NO: 64 Amino acid sequence encoded by rcorf68, similar to AGR_pTi_204 [*Agrobacterium tumefaciens* str. C58] and argG, argininosuccinate synthase, from *Streptomyces clavuligerus*.

65. SEQ ID NO: 65 Amino acid sequence encoded by rcorf69, similar to riorf100 in pRi1724, similar to ardc gene in pSa(IncW plasmid) COG4227, probable conjugal transfer protein (antirestriction protein).

66. SEQ ID NO: 66 Amino acid sequence encoded by rcorf70, similar to riorf110 in pRi1724, similar to mll9093 aspartate 1-decarboxylase [*Mesorhizobium loti* MAFF303099] and pgi gene in *Xanthomonas citri*, COG0853 [H] Aspartate 1-decarboxylase.

67. SEQ ID NO: 67 Amino acid sequence encoded by rcorf71, similar to similar to riorf106 in pRi1724, similar to a teuB gene in pRtrCFN299a, a COG1879: RbsB; ABC-type sugar transport system, periplasmic component [Carbohydrate transport and metabolism].

68. SEQ ID NO: 68 Amino acid sequence encoded by rcorf72, similar to riorf107 in pRi1724, similar to mcpC (mcpC gene in *Rhizobium*) gene in *Rhizobium leguminosarum*, a smart00283: MA; Methyl-accepting chemotaxis-like domains (chemotaxis sensory transducer).
69. SEQ ID NO: 69 Amino acid sequence encoded by rcorf77, probable traA gene, similar to riorf112 in pRi1724, COG0507: RecD; ATP-dependent exoDNAse (exonuclease V), alpha subunit—helicase superfamily I member [DNA replication, recombination, and repair].
70. SEQ ID NO: 70 Amino acid sequence encoded by rcorf79, probable traB gene, similar to riorf114 in pRi1724.
71. SEQ ID NO: 71 Amino acid sequence encoded by rcorf80, similar to riorf115 in pRi1724, a hypothetical protein of *Agrobacterium rhizogenes* (strain: MAFF03-01724)
72. SEQ ID NO: 72 Amino acid sequence encoded by rcorf82, probable traM gene similar to riorf118 in pRi1724, TraR antagonist.
73. SEQ ID NO: 73 Amino acid sequence encoded by rcorf96, probable repA gene similar to riorf132 *Agrobacterium rhizogenes* (strain: MAFF03-01724), a cd00550: ArsA_ATPase; Oxyanion-translocating ATPase (ArsA) and cd00592: HTH_MERR; Helix-turn-helix transcription regulator MERR, N-terminal domain.
74. SEQ ID NO: 74 Amino acid sequence encoded by rcorf97, probable repB gene similar to riorf133 in pRi1724, a smart00470: ParB; ParB-like nuclease domain protein.
75. SEQ ID NO: 75 Amino acid sequence encoded by rcorf98, probable repC gene similar to riorf134 in pRi1724, essential for vegetative replication.
76. SEQ ID NO: 76 Amino acid sequence encoded by rcorf99, similar to riorf135 in pRi1724, weakly similar to y4aO gene in pNGR234a.
77. SEQ ID NO: 77 Amino acid sequence encoded by rcorf103, similar to riorf137 gene in pRi1724 and orf4 gene in pTiA6NC.
78. SEQ ID NO: 78 Amino acid sequence encoded by rcorf105, similar to riorf139 in pRi1724, similar to uncharacterized region between y4jF and y4jG genes in pNGR234a.
79. SEQ ID NO: 79 Amino acid sequence encoded by rcorf106, similar riorf140 in pRi1724 and to orf300 gene in *Escherichia coli*, a pfam00004: AAA; ATPase family associated with various cellular activities (AAA).
80. SEQ ID NO: 80 Amino acid sequence encoded by rcorf107, similar to N-term of riorf141 in pRi1724, a hypothetical protein.
81. SEQ ID NO: 81 Amino acid sequence encoded by rcorf109, weakly similar to SERP1653 *Staphylococcus epidermidis* RP62A (strain: RP62A), a hypothetical protein.
82. SEQ ID NO: 82 Amino acid sequence encoded by rcorf110, similar to riorf142 in pRi1724, similar to gene for luminal binding protein exon 6 in *Arabidopsis thaliana*.
83. SEQ ID NO: 83 Amino acid sequence encoded by rcorf111, similar to riorf143 in pRi1724 and to spdB3 gene in pSG5.
84. SEQ ID NO: 84 Amino acid sequence encoded by rcorf112, similar to riorf144 in pRi1724.
85. SEQ ID NO: 85 Amino acid sequence encoded by rcorf114, putative virF gene, similar to riorf146 in pRI1724 and tiorf133 in pTiSAKURA.
86. SEQ ID NO: 86 Amino acid sequence encoded by rcorf117, similar to riorf149 in pRi1724, similar to N-term. aatA (atu2196) aspartate aminotransferase A [*Agrobacterium tumefaciens* str. C58].
87. SEQ ID NO: 87 Amino acid sequence encoded by rcorf119, probable virH, similar to riorf151 in pRi1724, cytochrome P450-type oxidase, likely type IV secreted protein via virB/D4.
88. SEQ ID NO: 88 Amino acid sequence encoded by rcorf120, probable virA, similar to riorf152 in pRi1724, receptor in two component virA/G regulatory system.
89. SEQ ID NO: 89 Amino acid sequence encoded by rcorf121, probable virB1, similar to riorf153 in pRi1724, type IV secretion system require for T-complex transfer.
90. SEQ ID NO: 90 Amino acid sequence encoded by rcorf123, probable virB3, similar to riorf155 in pRi1724, type IV secretion system require for T-complex transfer.
91. SEQ ID NO: 91 Amino acid sequence encoded by rcorf125, probable virB5, similar to riorf157 in pRi1724, type IV secretion system require for T-complex transfer.
92. SEQ ID NO: 92 Amino acid sequence encoded by rcorf126, probable virB6, similar to riorf158 in pRi1724, type IV secretion system require for T-complex transfer.
93. SEQ ID NO: 93 Amino acid sequence encoded by rcorf127, probable virB7, similar to riorf159 in pRi1724, type IV secretion system require for T-complex transfer.
94. SEQ ID NO: 94 Amino acid sequence encoded by rcorf129, probable virB9, similar to riorf161 in pRi1724, type IV secretion system require for T-complex transfer.
95. SEQ ID NO: 95 Amino acid sequence encoded by rcorf131, probable virB11, similar to riorf163 in pRi1724, type IV secretion system require for T-complex transfer.
96. SEQ ID NO: 96 Amino acid sequence encoded by rcorf132, probable virG, similar to riorf164 in pRi1724, activator in two component virA/G regulatory system.
97. SEQ ID NO: 97 Amino acid sequence encoded by rcorf133, hypothetical protein, similar to aa1-103 pf ISBm1 transposase orfB [*Brucella suis* 1330] (NP 697552).
98. SEQ ID NO: 98 Amino acid sequence encoded by rcorf137, probable virD1, similar to riorf167 in pRi1724, a virA/G regulate T-DNA border endonuclease accessory protein.
99. SEQ ID NO: 99 Amino acid sequence encoded by rcorf138, probable virD2, similar to riorf168 in pRi1724, the virA/G regulated T-DNA border endonuclease.
100. SEQ ID NO: 100 Amino acid sequence encoded by rcorf140, probable virD4, similar to riorf170 in pRi1724, virA/G regulated component of virB/D4 Type IV secretion system.
101. SEQ ID NO: 101 Amino acid sequence encoded by rcorf142, probable virF, similar to riorf172 in pRi1724, and less similar to tiorf133 in pTi-SAKURA, a type IV secretion protein via virB/D4 complex.
102. SEQ ID NO: 102 Amino acid sequence encoded by rcorf143, probable virE3, similar to riorf173 in pRi1724 and virE3 in pRiA6NC, interacts with virE2 and IMPA1 (AtKAP-alpha) in *A. tumefaciens*, virB/D4 type IV secreted protein.
103. SEQ ID NO: 103 Amino acid sequence encoded by rcorf144, similar to *Mesorhizobium loti* MAFF303099 mlr1626, predicted mannose-6-phosphate isomerase.
104. SEQ ID NO: 104 Amino acid sequence encoded by rcorf145, similar to phage integrase
105. SEQ ID NO: 105 Nucleic acid sequence encoding RF:: tet::LF region of pRi2659Δtet (comprising tetracyclin selection marker (tet))
106. SEQ ID NO: 106 Nucleic acid sequence encoding pRi2659
107. SEQ ID NO: 107 PCR primer within virG CDS 5'-TACTTCCTCC TCACGCACTC-3'

108. SEQ ID NO: 108 PCR primer within virB operon
5'-GCCAGCAATG ATCAAGAATT TGTTT-3'
109. SEQ ID NO: 109 PCR G109 forward primer
5'-TTGGTGCGAC AACTCCTCGG CG-3'
110. SEQ ID NO: 110 PCR G112 reverse primer
5'-GGTGAGCTCG ATCAGCTTCG GC-3'
111. SEQ ID NO: 111 Nucleic acid sequence encoding virD2 from pRi2659
112. SEQ ID NO: 112 Amino acid sequence for virD2 protein from pRi2659, also known as rcorf138
113. SEQ ID NO: 113 Complementary nucleic acid sequence from pRi2659 containing rcorf2 through rcorf12
114. SEQ ID NO: 114 Amino acid sequence encoded by rcorf12, weakly similar to riorf20 in pRi1724, similar to hypothetical protein Bcep02000338 [*Burkholderia fungorum* LB400].
115. SEQ ID NO: 115 Amino acid sequence encoded by rcorf11, similar to riorf40 in pRi1724, a hutH gene homolog, a cd01441: HAL; Histidine ammonia-lyase (HAL) catalyzes the first step in the degradation of histidine to glutamate
116. SEQ ID NO: 116 Amino acid sequence encoded by rcorf10, similar to transcriptional regulatory protein [*Bradyrhizobium japonicum* USDA 110], helix_turn_helix gluconate operon transcriptional repressor
117. SEQ ID NO: 117 Amino acid sequence encoded by rcorf9, similar to *A. tumefaciens* C58 hydantoin utilization protein hyuA
118. SEQ ID NO: 118 Amino acid sequence encoded by rcorf8, similar to *A. tumefaciens* C58 hydantoin utilization protein hyuB
119. SEQ ID NO: 119 Amino acid sequence encoded by rcorf7, similar to COG0834 *Burkholderia fungorum* LB400 COG0834, similar to STH1060, glutamine ABC transporter substrate-binding protein [*Symbiobacterium thermophilum* IAM 14863]
120. SEQ ID NO: 120 Amino acid sequence encoded by rcorf6, similar to COG0765 [*Burkholderia fungorum* LB400], similar to PSPTO5181, cystine ABC tranporter, permease protein, putative [*Pseudomonas syringae* pv. tomato str. DC3000]
121. SEQ ID NO: 121 Amino acid sequence encoded by rcorf5, similar to Bcep02000339 [*Burkholderia fungorum* LB400], similar to bir3310, COG0765: ABC transporter permease protein [*Bradyrhizobium japonicum* USDA 110]
122. SEQ ID NO: 122 Amino acid sequence encoded by rcorf4, N-term similar to STH1062, similar to glutamine ABC transporter ATP-binding protein [*Symbiobacterium thermophilum* IAM 14863]; C-term similar to bll6362, hypothetical protein in *Bradyrhizobium japonicum* USDA 110, COG2079 [R] Uncharacterized protein involved in propionate catabolism
123. SEQ ID NO: 123 Amino acid sequence encoded by rcorf3, weakly similar to mlr6097, nitrogen assimilation control protein [*Mesorhizobium loti* MAFF303099], COG0583 [K] Transcriptional regulator
124. SEQ ID NO: 124 Amino acid sequence encoded by rcorf2, similar to riorf1 in pRi1724, orf3 gene homolog in IS66
125. SEQ ID NO: 125 Complementary nucleic acid sequence from pRi2659 containing rcorf18
126. SEQ ID NO: 126 Nucleic acid sequence encoded by rcorf18, similar to AGR_L__1821 hypothetical protein [*Agrobacterium tumefaciens* str. C58], a sdeB gene homolog, cd01298: ATZ_TRZ_like; TRZ/ATZ family contains enzymes from the atrazine degradation pathway and related hydrolases
127. SEQ ID NO: 127 Complementary nucleic acid sequence from pRi2659 containing rcorf24 through rcorf31
128. SEQ ID NO: 128 Amino acid sequence encoded by rcorf31, similar riorf59 in pRi1724, similar to orf3 gene in *Methylobacterium extorquens*, COG3931 [E] Predicted N-formylglutamate
129. SEQ ID NO: 129 Amino acid sequence encoded by rcorf30, similar to riorf58 in pRi1724, a eutB homolog, ethanolamine ammonia-lyase heavy chain
130. SEQ ID NO: 130 Amino acid sequence encoded by rcorf28, probable GALLS gene, similar to riorf55 in pRi1724, complements virE2, unknow mechanism, required for efficient stable plant transformation.
131. SEQ ID NO: 131 Amino acid sequence encoded by rcorf27, probable transt-zeatin synthase, similar to riorf54 in pRi1724, EC 2.5.1.-.
132. SEQ ID NO: 132 Amino acid sequence encoded by rcorf26, probable idi gene, similar to riorf53 in pRi1724, similar to idi, isopentenyl-diphosphate delta-isomerase [*Mycobacterium tuberculosis* CDC1551] EC 5.3.3.2.
133. SEQ ID NO: 133 Amino acid sequence encoded by rcorf25, similar to riorf52 in pRi1724, similar MCA2182 decarboxylase family protein [*Methylococcus capsulatus* str. Bath]
134. SEQ ID NO: 134 Amino acid sequence encoded by rcorf24, similar to riorf51 in pRi1724, weakly similar to mtrR gene of the tetR bacterial regulatory family.
135. SEQ ID NO: 135 Complementary nucleic acid sequence from pRi2659 containing rcorf42 through rcorf43
136. SEQ ID NO: 136 Amino acid sequence encoded by rcorf43, similar to riorf73 in pRI1724, similar to SMa2002 [*Sinorhizobium meliloti* 1021], COG2755 [E] Lysophospholipase L1 and related esterases.
137. SEQ ID NO: 137 Amino acid sequence encoded by rcorf42, similar to riorf73 in pRi1724, hypothetical repressor gene, similar to SMa2004 [*Sinorhizobium meliloti* 1021], putative ROK-family transcriptional regulator.
138. SEQ ID NO: 138 Complementary nucleic acid sequence from pRi2659 containing rcorf74 through rcorf76
139. SEQ ID NO: 139 Amino acid sequence encoded by rcorf76, probable traC gene, Ti plasmid conjugal DNA processing, similar to riorf111 in pRi1724.
140. SEQ ID NO: 140 Amino acid sequence encoded by rcorf74, probable traG gene, similar to riorf109 in pRi1724, a cd01126: TraG_VirD4; The TraG/TraD/VirD4 family are bacterial conjugation proteins.
141. SEQ ID NO: 141 Complementary nucleic acid sequence from pRi2659 containing rcorf83 through rcorf95
142. SEQ ID NO: 142 Amino acid sequence encoded by rcorf95, probable traI gene similar to riorf131 in pRi1724, a LuxI-type quorum sensing regulators, synthesizes 3-oxooctanoylhomoserine lactone, a pfam00765: Autoind_synth; Autoinducer synthetase.
143. SEQ ID NO: 143 Amino acid sequence encoded by rcorf94, probable trbB gene similar to riorf130 in pRi1724, Type IV transfer system required for Ri/Ti plasmid conjugation.
144. SEQ ID NO: 144 Amino acid sequence encoded by rcorf93, probable trbC gene similar to riorf129 in pRi1724, Type IV transfer system required for Ri/Ti plasmid conjugation.
145. SEQ ID NO: 145 Amino acid sequence encoded by rcorf91, probable trbE gene similar to riorf127 in pRi1724, Type IV transfer system required for Ri/Ti plasmid conjugation.

146. SEQ ID NO: 146 Amino acid sequence encoded by rcorf89, trbK gene homolog similar to riorf125 in pRi1724, Type IV transfer system required for Ri/Ti plasmid conjugation.
147. SEQ ID NO: 147 Amino acid sequence encoded by rcorf88, probable trbF gene similar to riorf123 in pRi1724, Type IV transfer system required for Ri/Ti plasmid conjugation.
148. SEQ ID NO: 148 Amino acid sequence encoded by rcorf87, probable trbF gene similar to riorf123 in pRi1724, Type IV transfer system required for Ri/Ti plasmid conjugation.
149. SEQ ID NO: 149 Amino acid sequence encoded by rcorf86, probable trbG gene similar to riorf122 in pRi1724, Type IV transfer system required for Ri/Ti plasmid conjugation.
150. SEQ ID NO: 150 Amino acid sequence encoded by rcorf85, probable trbH gene similar to riorf121 in pRi1724, Type IV transfer system required for Ri/Ti plasmid conjugation.
151. SEQ ID NO: 151 Amino acid sequence encoded by rcorf84, probable trbI gene similar to riorf120 in pRi1724, a pfam03743: TrbI; Bacterial conjugation TrbI-like protein.
152. SEQ ID NO: 152 Amino acid sequence encoded by rcorf83, probable traR gene similar to riorf119 in pRi1724 and traR/AGR pTi 249 in pTiC58.
153. SEQ ID NO: 153 Complementary nucleic acid sequence from pRi2659 containing rcorf100 through rcorf102
154. SEQ ID NO: 154 Amino acid sequence encoded by rcorf102, similar to hypothetical integrase gene orf2 (similar to *Pseudomonas* integrase-like gene) in pTiA6NC.
155. SEQ ID NO: 155 Amino acid sequence encoded by rcorf101, similar to N-term. fragment of pAT 22 *Agrobacterium tumefaciens* str. C58 (strain: C58, isolate: Cereon), a COG0582 [L] Integrase protein.
156. SEQ ID NO: 156 Amino acid sequence encoded by rcorf100, similar to C-term of pAT 22 *Agrobacterium tumefaciens* str. C58 (strain: C58, isolate: Cereon), a COG0582 [L] Integrase protein.
157. SEQ ID NO: 157 Complementary nucleic acid sequence from pRi2659 containing rcorf115 through rcorf116
158. SEQ ID NO: 158 Amino acid sequence encoded by rcorf116, probable potassium uptake protein, similar to Atu0711 i *Agrobacterium tumefaciens* str. C58 and riorf148 in pRi1724 and to kup gene, a pfam02705: K_trans; K+ potassium transporter protein.
159. SEQ ID NO: 159 Amino acid sequence encoded by rcorf115, similar to riorf147 in pRi1724 and y4mC gene in pNGR234a homolog, a vir induced gene.
160. SEQ ID NO: 160 Complementary nucleic acid sequence from pRi2659 containing rcorf134 through rcorf136
161. SEQ ID NO: 161 Amino acid sequence encoded by rcorf136, probable virC1, similar to riorf166 in pRi1724, virulence virA/G regulated protein, AGR_pTi_18p; VirC1; binds to overdrive sequence adjacent to right border of T-DNA; increases the level of T-DNA processing.
162. SEQ ID NO: 162 Amino acid sequence encoded by rcorf135, probable virC2, similar to riorf165 in pRi1724, T-DNA processing virulence virA/G regulated protein.
163. SEQ ID NO: 163 Amino acid sequence encoded by rcorf134, hypothetical protein, similar to aa4-122/142 of ISBm1 transposase orfA [*Brucella suis* 1330] (NP 697551).
164. SEQ ID NO: 164 Amino acid sequence encoded by rcorf15, similar to SMa2207, a putative ABC transporter, ATP-binding protein [*Sinorhizobium meliloti* 1021], a COG3842: PotA; ABC-type spermidine/putrescine transport systems, ATPase components [Amino acid transport and metabolism]
165. SEQ ID NO: 165 Amino acid sequence encoded by rcorf17, probable cucumbopine transporter, similar to riorf34, a hypothetical protein [*Agrobacterium rhizogenes*] the probable mikimopine transporter gene
166. SEQ ID NO: 166 Amino acid sequence encoded by rcorf29, similar to riorf57 in pRi1724, a eutC homolog, ethanolamine ammonia-lyase light chain
167. SEQ ID NO: 167 Amino acid sequence encoded by rcorf33, similar to riorf61 in pRi1724, hypothetical ABC-transporter gene similar to PH0807, pfam00496: SBP_bac_5; Bacterial extracellular solute-binding proteins, family 5
168. SEQ ID NO: 168 Amino acid sequence encoded by rcorf38, similar to riorf67 in pRI1724, weakly similar to pck gene, smart00587: CHK; ZnF_C4 abd HLH domain containing kinases domain
169. SEQ ID NO: 169 Amino acid sequence encoded by rcorf49, similar to riorf79 in pRi1724, a glpK (glycerol kinase) gene homolog, EC 2.7.1.30.
170. SEQ ID NO: 170 Amino acid sequence encoded by rcorf65, similar riorf95 in pRI1724, similar to downstream region of nylA gene in pOAD2.
171. SEQ ID NO: 171 Amino acid sequence encoded by rcorf73, similar to AGR_pTi_225 nuclease [*Agrobacterium tumefaciens* str. C58], a COG1525 [L] Micrococcal nuclease (thermonuclease) homologs.
172. SEQ ID NO: 172 Amino acid sequence encoded by rcorf75, probable traD gene, conjugal transfer protein similar to riorf110 in pRi1724.
173. SEQ ID NO: 173 Amino acid sequence encoded by rcorf78, probable traF gene, similar to riorf113 in pRi1724, COG4959: TraF; Type IV secretory pathway, protease TraF [Posttranslational modification, protein turnover, chaperones/Intracellular trafficking and secretion].
174. SEQ ID NO: 174 Amino acid sequence encoded by rcorf81, similar to riorf117 in pRi1724, a hypothetical protein or *Agrobacterium rhizogenes* (strain: MAFF03-01724), a cd00093: HTH_XRE; Helix-turn-helix XRE-family like proteins.
175. SEQ ID NO: 175 Amino acid sequence encoded by rcorf90, probable trbJ gene similar to riorf126 in pRi1724, Type IV transfer system required for Ri/Ti plasmid conjugation, COG5314; Conjugal transfer/entry exclusion protein [Intracellular trafficking and secretion].
176. SEQ ID NO: 176 Amino acid sequence encoded by rcorf92, probable trbD gene similar to riorf128 in pRi1724, Type IV transfer system required for Ri/Ti plasmid conjugation.
177. SEQ ID NO: 177 Amino acid sequence encoded by rcorf104, similar to riorf138 in pRi1724 and gvp1 gene in pHH1, a pfam04079: DUF387; Putative transcriptional regulators (Ypuh-like) protein.
178. SEQ ID NO: 178 Amino acid sequence encoded by rcorf108, similar to C-term of riorf141 in pRi1724, a hypothetical protein.
179. SEQ ID NO: 179 Amino acid sequence encoded by rcorf113, weak similar over 79 aa to bir8180 of *Bradyrhizobium japonicum* USDA 110 (strain: USDA 110), a COG1760 [E] L-serine deaminase.
180. SEQ ID NO: 180 Amino acid sequence encoded by rcorf118, similar to riorf150 in pRi1724, aatA gene in *Rhizobium leguminosarum* homolog, hypothetical pseudogene which is divided by frame-shift.

181. SEQ ID NO: 181 Amino acid sequence encoded by rcorf122, probable virB2, similar to riorf154 in pRi1724, type IV secretion system require for T-complex transfer.
182. SEQ ID NO: 182 Amino acid sequence encoded by rcorf124, probable virB4, similar to riorf156 in pRi1724, type IV secretion system require for T-complex transfer.
183. SEQ ID NO: 183 Amino acid sequence encoded by rcorf128, probable virB8, similar to riorf160 in pRi1724, type IV secretion system require for T-complex transfer.
184. SEQ ID NO: 184 Amino acid sequence encoded by rcorf130, probable virB10, similar to riorf162 in pRi1724, type IV secretion system require for T-complex transfer.
185. SEQ ID NO: 185 Amino acid sequence encoded by rcorf139, probable virD3, similar to riorf169 in pRi1724, virA/G regulated, not required for virulence, possible host range factor.
186. SEQ ID NO: 186 Amino acid sequence encoded by rcorf141, probable virD5, similar to riorf171 in pRi1724, virA/G regulated component of virB/D4 Type IV secretion system.
187. SEQ ID NO: 187 Amino acid sequence encoded by rcorf146, similar to Y4rB *Rhizobium* sp. NGR234.
188. SEQ ID NO: 188 Nucleotide sequence encoding *Agrobacterium* strain K599 left T-DNA flanking sequence.

EXAMPLES

Unless indicated otherwise, chemicals and reagents in the Examples are obtained from Sigma Chemical Company (St. Louis, Mo.), restriction endonucleases are from New England Biolabs (Beverly, Mass.) or Roche (Indianapolis, Ind.), oligonucleotides were synthesized by MWG Biotech Inc. (High Point, N.C.), and other modifying enzymes or kits regarding biochemicals and molecular biological assays are from Clontech (Palo Alto, Calif.), Pharmacia Biotech (Piscataway, N.J.), Promega Corporation (Madison, Wis.), or Stratagene (La Jolla, Calif.). Materials for cell culture media are obtained from Gibco/BRL (Gaithersburg, Md.) or DIFCO (Detroit, Mich.). The cloning steps carried out for the purposes of the present invention, such as, for example, restriction cleavages, agarose gel electrophoresis, purification of DNA fragments, transfer of nucleic acids to nitrocellulose and nylon membranes, linking DNA fragments, transformation of *E. coli* cells, growing bacteria, multiplying phages and sequence analysis of recombinant DNA, are carried out as described by Sambrook (1989). The sequencing of recombinant DNA molecules is carried out using ABI laser fluorescence DNA sequencer following the method of Sanger (Sanger 1977) unless noted otherwise. The following examples are offered by way of illustration and not by way of limitation.

Example 1

Disarming *Agrobacterium* Strain K599

*Agrobacterium* strain K599 is a soil bacterium that causes the hairy root disease in many dicotyledonous plants including soybean. Strain K599 has been shown to be highly infective on soybean roots. *Agrobacterium* strain K599 (deposited under Accession-Number NCPPB2659 in the British NCPPB stock center; www.ncppb.com National Collection of Plant Pathogenic Bacteria Central Science Laboratory, Sand Hutton, York YO41 1LZ England) was grown in liquid culture (LB medium) at 28° C. and DNA extraction protocols modified to purify pRi plasmids were performed using Qiagen Large Construct kit catalog No. 12462 to enrich the DNA preparation for pRi2659 plasmid.

Southern hybridizations using right (285 bp) or left border (240 bp) probes were done to verify the correctness of the physical restriction map of the T-DNA region of pRi2659 (see FIG. 6). It was determined that the restriction enzyme SphI yielded acceptable (larger than 2 kb flanking) fragments to use as homologous regions for a deletion vector. A sub genomic clone bank of K599 pRi2659 SphI fragments was constructed in pUC19. Isolated *Agrobacterium* strain K599 DNA enriched for pRI2659 plasmid was digested with SphI and run on a 0.8% agarose gel. Fragment regions representing a 2905 bp fragment containing right flank DNA and a 7,498 bp fragment containing left flank DNA were excised from the agarose gel and purified using a Qiagen QIAquick gel extraction kit catalog No. 28706. These purified gel fragments were ligated into pUC19 to generate a sub-genomic clone bank.

Colony lifts from the clone bank were probed with either right border or left border fragments to identify clones containing flanking DNA. Two clones were identified: a 2,905 bp fragment containing right flank DNA and a 7,498 bp fragment containing left flank DNA. Each of these clones were further subcloned and sequenced using standard forward and reverse primers (SEQ ID NO: 1 and 2, respectively).

The *Agrobacterium* deletion cassette was constructed using 2.1 kb fragments from each flanking clone. The homologous regions provide ample space for the double homologous recombination to take place. A similar cassette was constructed that contained the tetracycline resistance gene between the RF and LF fragments (see FIG. 12 for flow chart). These constructs were sequence verified. The RF/LF and RF/Tet/LF cassettes were cloned into a linker modified version of pRL278 (SEQ ID NO: 3; Peter Wolk, Michigan State University) resulting in plasmid vector pRL278LF/RF (SEQ ID NO: 23; without Tet-cassette) and plasmid vector pBPSSH009 (SEQ ID NO: 22; with Tet-cassette), respectively. These vectors allow for efficient selection of double homologous recombinants by the use of the sacB gene. The addition of sucrose to the growth media containing single homologous recombinants produces the toxic compound levan. This compound acts as a counter selection against strains containing the plasmid, forcing a double cross over resolving the wild type phenotype or the desired deletion. pBPSSH009 and pRL278LF/RF, respectively, were introduced by electroporation into strain K599 and selected using kanamycin 100 µg/mL. Single crossovers containing the deletion plasmid that has integrated into the Ri plasmid were recovered and counter selection on sucrose was performed. Sucrose/sacB selection was carried out as follows: Confirmed (by Southern hybridization) single cross-over events containing the kanamycin resistant vector with sacB and deletion construct were grown overnight without selection to allow for recombination to take place. A serial dilution of the culture was plated on LB agar counter selection media containing 5% sucrose v/v. After 2 days colonies that appeared were grown and genomic DNA was isolated and used to confirm the deletion of the T-DNA region by Southern hybridization. Double-crossovers were isolated and molecular confirmation of the T-DNA deletion was confirmed by Southern hybridization (FIG. 6). The probe used in the Southern hybridization was the same one used above to isolate the fragment containing the right flanking region of pRi2659. It is a 200 bp fragment that contains the right border and flanking sequence both upstream and downstream of the border. For the Southern blot the genomic DNA samples were digested with SphI and run on 0.8% agarose gel.

The Obtained Strains were Named as Follows:

*Agrobacterium* K599 [pRi2659Δtet] strains: SHA001 and SHA016 are disarmed *Agrobacterium* K599 strains lacking its T-DNA region comprising a tetracycline (tet) expression cassette (obtained by using pBPSSH009). *Agrobacterium* strains SHA001 and SHA016 are both functionally equivalent strains of the disarmed, tetracycline-resistant type, i.e. comprising the pRi2659Δtet plasmid.

*Agrobacterium* K599 [pRi2659Δ] strain: SHA017 is a disarmed *Agrobacterium* K599 strain lacking its T-DNA region (obtained by using pRL278LF/RF, also known as pBPSSH009b).

Functional tests for hairy root syndrome on soybean cotyledons (see below, Example 2) confirmed the loss of the disease phenotype. Plant transformation experiments in soybean, maize, tomato and *Arabidopsis* were performed (see below) and confirmed plant infective properties of the disarmed strain. In all plant species, transient β-glucuronidase (GUS) expression was detected. Furthermore, stable GUS expression was detected in various plant species including soybean, maize and tomato tissues. Stable Pursuit™ and glufosinate resistant *Arabidopsis* plants have also been recovered. The super-virulent pSB1 plasmid (Komari 1996) has been mobilized into the disarmed K599 strain and proofed to be effective in maize transformation.

Example 2

Hairy Root Assays

Soybean seeds (cultivar Williams 82) were used for the following assay.1. 6 days before inoculation, soybean seeds are sterilized. Seeds without wounds/cracks on the surface are place in a sterile beaker. 30 seeds for each *Agrobacterium* strain to be assessed are used and covered with 95% ethanol for a minute. The ethanol is removed and the seeds are treated with freshly prepared 10% bleach with 0.0005% TritonX-100 for 10 min. The bleach is changed every 3 minutes. Afterwards the bleach is poured off and the seeds are washed in sterile water 4 times. 10 seeds each are placed on a 1% agar plate, sealed with Parafilm™ and placed in 25° C., 16 hr/day lighting (70-100 µE/m$^2$s).

*Agrobacterium* Inoculation for Hairy Root Assay:

Before inoculation, the germinated soybeans are placed under a laminar hood. A fresh overnight *Agrobacterium* culture is removed from the shaker and OD$_{650}$ is determined. An aliquot of 1 mL is placed into a sterile microfuge tube and the Agrobacteria are precipitated at 12,000 rpm for 3 minutes. The supernatant is removed and the Agrobacteria are resuspended with infection media (1× MS salts, 3.6% glucose, 6.9% sucrose, 100 mg/L myo-inositol, 1.5 mg/L 2,4-D, 1 mg/L cas amino acids, 1 mg/L thiamine HCl, 0.5 mg/L nicotinic acid, 0.5 mg/L pyridoxine HCl).

OD$_{650}$ is adjusted to 1.0. The Agrobacteria are incubated in infection media for 1 hour prior to infection to induce the vir gene cascade. Only the green cotyledons are cut off the seedlings and the adaxial side is wounded with a scalpel. The cotyledons are place on agar plates with abaxial side up. The wounded surface of each cotyledon is inoculated with 17 to 20 µL Agrobacteria. The plates are sealed with Parafilm and placed at 25° C., 16 hr/day lighting condition (70-100 µE/m$^2$s) for co-cultivation. Three days after inoculation, the cotyledons are transferred onto selection media (1× MS Salts, 1× Gamborgs B5 vitamins, 3% sucrose, 100 mg/L carbinicillin, pH 6.2 with KOH). The plates sealed and place back into the same culturing condition. After two weeks hairy roots can be detected and harvested that are growing into the surface of the media (for hairy-root inducing strains). Harvested roots are placed on selection media. After additional two to three weeks, root lines that are growing on the selection media are subcultured onto media that does not comprise selection agent. They should be subcultured every 4 weeks. Roots should be cultured in the dark.

Example 3

Growth and Preparation of *Agrobacterium* for Plant Transformation

*Agrobacterium* cultures are prepared by streaking bacteria carrying the desired binary vector onto solid YEP growth medium and incubate at 25° C. until colonies appear (about 2 days). Depending on the selectable marker genes present on the Ri plasmid, the binary vector, and the bacterial chromosomes, different selectable agents can be used for *A. tumefaciens* and *rhizogenes* selection in the YEP solid and liquid media. After approximately two days, a single colony is isolated (with a sterile toothpick) and inoculated in 50 ml of liquid YEP with antibiotics under shaking (175 rpm, 25° C.) until an OD$_{850}$ between 0.8 to 1.0 is reached (approximately 2 days). Working glycerol stocks (15%) for transformation are prepared and stored as one-ml *Agrobacterium* stocks in 1.5 mL Eppendorf tubes at −70° C.

YEP Growth Medium (*Agrobacterium* Medium):

10 g/L Bacto-peptone, 5 g/L yeast extract, 5 g/L NaCl, 12 g/L agar (Difco), appropriate antibiotics; pH 7.0

The day before explant inoculation, 200 mL of YEP are inoculated with 5 µL to 3 mL of working *Agrobacterium* stock in a 500 mL Erlenmeyer flask. Shake the flask overnight at 25° C. until the OD$_{650}$ is between 0.8 and 1.0. Before preparing the soybean explants, the Agrobacteria are pelleted by centrifugation for 10 min at 5,500×g at 20° C. The pellet is resuspended in liquid CCM medium to the desired density (OD$_{650}$ 0.5 to 0.8) and placed at room temperature at least 30 minutes before use.

Liquid CCM Medium (=Co-Cultivation Medium):

⅒B5 salts, ⅒MS iron stock, 3% sucrose, 20 mM MES, 1× B5 vitamins, 200 µM acetosyringone, 0.7 µM gibberellic acid, 7.5 µM 6-benzyl-aminopurine; pH 5.4.

Example 4

Plant Transformation

Example 4a

Soybean Transformation

Seedling and *Agrobacterium* Preparation

Soybean seeds of various cultivars are sterilized for 24 to 48 hours in a chlorine gas by adding 3.5 mL HCl to 100 mL bleach (5.25% sodium hypochlorite) in a desiccator with a tightly fitting lid. After sterilization, the seeds are removed and approximately 20 seeds are plated onto germination medium [1× B5 major salts, 1× B5 minor salts, 1× MSIII iron, 2% Sucrose, 1× B5 vitamins, 0 to 5 µM BAP, 0.8% Purified Agar (Sigma); pH 5.8] in PlantCon containers. The seedlings are grown in the light (150 µm$^2$s) until the cotyledons are green, the seed coat has split, and the epicotyl has expanded to approximately 0.5 cm in length (approximately 7 days) for leaf explants and 1 to 4 cm for seedling explants.

The disarmed *Agrobacterium* strain K599 (pRi2659Δtet) or *A. tumefaciens* strain AGL1 carrying the binary vector pBPSEW008 [p-NOS::c-bar:t-NOS p-PcUBI::c-gusINT::t-NOS] (SEQ ID NO: 15) or pBPSMM192b [pAtAhas::c-csr1-2::t-AtAHAS t-NOS::c-gusINT::p-SUPER] (SEQ ID NO: 16) was streaked onto solid YEP [10 g/L Bacto-peptone (Difco; Becton, Dickinson, and Co., Cockeysville, Md., USA), 5 g/L Yeast-extract (Difco), 5 g/L NaCl, 50 mg/l kanamycin, 1.2% granulated agar (Difco) solid only; pH 7.0] and incubated at 25° C. for 2 days. A single colony was picked with a sterile toothpick and placed in 50 mL of liquid YEP with antibiotics and shaken (175 rpm) at 25° C. for 16 h. After reaching an $OD_{650}$ 0.8 to 1.0, 15% glycerol working stocks were made and stored at minus 80° C. One day before explant inoculation, working stocks (depends on growth and stock concentration of *Agrobacterium*, anywhere between 5 µL to 50 µL) of *Agrobacterium* strain plus 50 mg/L kanamycin were added to YEP liquid medium in an Erlenmeyer flask. The flasks were shaken overnight at 25° C. until the $OD_{650}$ reached 0.8. Before preparing the soybean explants, the *Agrobacterium* was pelleted by centrifugation for 10 min at 5,500×g at 20° C. and resuspended in liquid co-cultivation medium [1/10× B5 major salts, 1/10× B5 minor salts, 1/10× MSIII iron, 1× B5 vitamins, 3% sucrose, 20 mM MES, 200 µM acetosyringone, 0.72 µM $GA_3$, 7.5 µM BAP; pH 5.4] to the desired density (e.g. $OD_{650}$ 0.5) and incubated at room temperature 30 min.

Explant Preparation and Inoculation

Leaf explant: The cotyledon and epicotyl were removed from the hypocotyl 2 mm below the cotyledonary-node. To expose the epicotyl and the unifoliate leaves, the cotyledons were separated from one another and then the epicotyl was removed above the cotyledonary-node. The primary leaves, which consist of the lamina, the petiole, and the stipules, were removed at the primary-node by carefully cutting at the base of the stipules such that the axillary meristems were included on the explant. The explant was wounded by cutting the area between the stipules with a sharp scalpel 3 to 5 times and all preformed shoots were removed.

Seedling explant: The explants are prepared by removing the majority of the roots at the hypocotyl/epicotyl junction or above on the hypocotyl (if hypocotyl is very long), one cotyledon and any axillary tissue growth at this node, the epicotyl just above the primary node including the apical tip, and all preformed leaves from the primary-node. The primary-node is then injured by stabbing into the tip of the epicotyl where the axillary meristems lie using a sharp scalpel 5 to 10 times.

After explant preparation, the explants were completely immersed in the Agrobacteria suspension for 30 min. After incubation, leaf explants were blotted onto sterile filter paper to remove excess *Agrobacterium* culture and placed with the wounded side in contact with a round 7 cm filter paper overlaying the solid co-cultivation medium [1/10× B5 major salts, 1/10× B5 minor salts, 1/10× MSIII iron, 1× B5 vitamins, 3% Sucrose, 20 mM MES, 200 µM AS, 0.72 µM $GA_3$, 7.5 µM BAP, (0.825 to 8.25 mM L-cysteine, Sigma, 0 to 1 mM dithiothreitol, 0 to 1 mM sodium thiosulfate), 0.5% Purified Agar, pH 5.4]. The seedling explants were transferred onto the filter paper overlaying the co-cultivation medium without blotting. This filter paper prevents *Agrobacterium* overgrowth on the soybean explants. Five plates were wrapped with Parafilm "M" (American National Can, Chicago, Ill., USA). The leaf explants were incubated for two days and the seedling explants for 5 days in the dark at 25° C.

Selection and Plant Regeneration

After incubation, excess *Agrobacterium* was removed by washing the explants in liquid shoot induction medium [1× B5 major salts, 1× B5 minor salts, 1× MSIII iron, 1× B5 vitamins, 3% Sucrose, 3 mM MES, 1.0 uM (seedling explant) or 2.5 µM BAP (leaf explant), 5 µM Kinetin, 250 mg/l ticarcillin; pH 5.6] and the leaf explants blot-dried on sterile filter paper to prevent water damage, especially on the lamina. Next, approximately 10 leaf explants and 5 seedling explants were transferred onto solid shoot induction medium [0.8% purified agar (Sigma)] without glufosinate selection for 7 days. The leaf explants were placed into the medium such that leaf lies perpendicular to the surface of the medium with the petiole embedded into the medium and the lamina out of the medium and the seedling explants with the entire epicotyl in contact with the medium. Plates were wrapped with Scotch 394 venting tape (3M, St. Paul, Minn., USA) and placed in a growth chamber with a temperature averaging 25° C. under 18 h light/6 h dark cycle at 70-100 µE/m²s.

After 7 days, the leaf explants were transferred to shoot induction medium with 3.0 mg/L glufosinate and seedling explants to shoot induction medium with 5.0 mg/L glufosinate. At this time, there was considerable de novo shoot development at the base of the petiole on leaf explants and at the tip of the epicotyl at the primary-node on seedling explants. After 2 weeks on shoot induction medium with selection, the leaf explants were transferred to shoot elongation medium [1× MS major salts, 1× MS minor salts, 1× MSIII iron, 1× B5 vitamins, 3% sucrose, 3 mM MES, 0.378 mM L-asparagine, 0.775 mM L-pyroglutamic acid, 0.057 µM IAA, 1.44 µM $GA_3$, 2.85 µM trans-zeatin riboside, 250 mg/L ticarcillin, 0.8% purified agar (Sigma); pH 5.6] with 3 mg/L glufosinate selection to stimulate shoot elongation of the shoot primordia. For seedling explants, the shoot pad is removed from the explant from the tip of the epicotyl and transferred to the same shoot elongation medium. The explants were then transferred into fresh SEM medium every 3 weeks until the explant dies or healthy shoots elongate. During transfer, the dead shoots were removed and the base of the explant where the callus tissue forms was cut to help facilitate nutrient and water transfer to the shoots above. Elongated shoots were then transferred to rooting medium (½× B5 salts, ½× MS iron stock, 2% sucrose, 3 mM MES, 5 µM Indole-butyric acid, 250 mg/L Timentin, 0.8% Noble agar; pH 5.6) until roots formed. The rooted shoot was then transferred to soil (1:1 (w/w) Carolina soil:Metro mix) in a growth chamber under 20 hours light until the third trifoliate expanded. The plants were then grown to maturity in a greenhouse under a 16 hour light/8 hour dark regime.

GUS Histochemical Assays

Leaf explants were assessed for GUS activity placing in GUS histochemical stain [80 mM $Na_2HPO_4$ (pH 8.0), 8 mM $Na_2EDTA$, 0.8% (v/v) Triton-X, 1.6% (v/v) dimethyl sulfoxide, 20% (v/v) methanol, 0.38 mM $K_4Fe(CN)_6$, 1 mM X-glucuro CHA salt (Inalco, Milan, Italy)] for 1 day at 37° C., after which the leaf tissue was washed in 70% (v/v) ethanol and cleared in 95% ethanol (Jefferson 1987; Kosugi 1990).

Experimental Design

For experiment one, 40 explants were prepared for inoculation with AGL1 or SHA016 carrying the binary pBPSMM192b (SEQ ID NO: 16) and assayed for transient GUS expression 5 days after co-cultivation. In a second experiment with 3 repetitions, shoot regeneration was tested on a total of 120 explants inoculated with different concentrations ($OD_{650}$: 0, 0.125, 0.25, 0.5) of *Agrobacterium* AGL1 or SHA016, both carrying pBPSEW008 (SEQ ID NO: 15). In a third experiment, 120 explants were prepared for inoculation with SHA016 or AGL1, both carrying pBPSEW008 (SEQ ID NO: 15), and a subset was stained for stable GUS expression 36 days after co-cultivation. Putative transformation frequencies were determined in a fourth experiment by assaying GUS histological staining on elongating shoots from seedling explants transformed with either *Agrobacterium* strain SHA017 (pSB1) or AGL1, both carrying pBPSE008 (SEQ ID NO: 15). This experiment consisted of 5 different inoculation dates.

In the first experiment, both *A. tumefaciens* AGL1 and the disarmed *Agrobacterium* strain K599 (SHA016) were successful in transferring the T-DNA into the petiole of the leaf explant (FIG. 3). Forty-two and a half percent of the explants infected with AGL1 showed GUS+ foci in the target areas, while SHA016 showed GUS+ foci in 10% of the target areas (Table 1). The reduction in transient GUS expression on those explants infected with SHA016 was mainly a result in tissue death during co-cultivation.

TABLE 1

The capacity of *Agrobacterium* strains AGL1 and SHA016 to infect leaf explants.

| Strain | Total explants infected | Explants with GUS (+) foci at target areas |
|---|---|---|
| AGL1 | 40 | 17 (42.5%) |
| SHA016 | 40 | 4 (10%) |

In the second experiment, the regeneration potential of explants inoculated with different concentrations of disarmed K599 did not significantly differ from one another in this study.

TABLE 2

Regeneration potential of explants inoculated with different concentrations of disarmed K599

| Repetition | OD 650: 0 | OD 650: 0.125 | OD 650: 0.25 | OD 650: 0.5 |
|---|---|---|---|---|
| 1 | 8/10 | 8/10 | 9/10 | 3/10 |
| 2 | 10/10 | 8/10 | 8/10 | 6/10 |
| 3 | 3/10 | 4/10 | 9/10 | 9/10 |

In the third experiment, all explants that were sacrificed to GUS histochemical staining after 35 days post-inoculation showed stable GUS expression on the leaf explants (FIG. 4).

A total of 900 seedling explants were prepared in the fourth experiment, of which 288 were inoculated with AGL1 (pBPSEW008) and 612 were inoculated with SHA017 (pSB1, pBPSEW008) (Table 3). In this study, one GUS+ shoot (0.35%) was identified from explants inoculated with AGL and 25 independent GUS+ shoots (4.1%) were identified from explants inoculated with SHA017. Of these, ten of the shoots from the SHA017 treatment developed into mature T0 plants. Southern analysis of the ten $T_0$ plants confirmed that each plant was an independent transformation event based on the T-DNA integration patterns in the plant genome. Inheritance of the T-DNA into the $T_1$ progenies of one line, 21-2, was also confirmed by Southern hybridization of the plant genomic DNA to probes of the gus and bar genes (FIG. 15).

TABLE 3

Production of gus+ elongated shoots and plants from seedling explants inoculated with either *Agrobacterium* strain AGL1 or SHA017.

| Experiment # | *Agrobacterium* strain | number of explants Inoculated | # explants with GUS+ elongated shoot | # GUS+ mature plants |
|---|---|---|---|---|
| E071304 | AGL | 35 | 0 | 0 |
| E071304 | SHA017 | 174 | 3 | 0 |
| E071504 | AGL | 104 | 0 | 0 |
| E071504 | SHA017 | 93 | 5 | 3 |
| E071904 | AGL | 100 | 1 | 0 |
| E071904 | SHA017 | 100 | 9 | 2 |
| E072204B | AGL | 27 | 0 | 0 |
| E072204B | SHA017 | 108 | 0 | 0 |
| E072804B | AGL | 22 | 0 | 0 |
| E072804B | SHA017 | 137 | 8 | 5 |

Example 4b

Transformation of *Arabidopsis thaliana*

*Arabidopsis thaliana* plants (ecotype CoI-0) were grown in soil until they flowered primary bolts were removed to increase flowers in secondary bolts. *Agrobacterium* strains MP90 (GV3101 (pMP90); Koncz and Schell 1986), SHA001 and wild type K599 were transformed with the constructs of interest pBPSEW008 (SEQ ID NO: 15) and pBPSMM192b (SEQ ID NO: 16) and grown in 250 mL in liquid LB medium (10 g/L tryptone, 5 g/L yeast extract, 10 g/L NaCl (EM Science)) until the culture reached an $OD_{650}$ 1.2. The bacterial cells were harvested by centrifugation (15 minutes, 4,000×g) and resuspended in infiltration solution (5% sucrose, 0.05% SILWET L-77 [Lehle Seeds, Cat.No. VIS-02], 0.217% MS Salts [Sigma M5524]) to an $OD_{650}$ of 0.8-0.9.

Flowering *A. thaliana* plants were then transformed by the floral dip method (Clough and Bent 1998) with the transgenic *Agrobacterium* strain carrying the vector described above by dipping for 10-20 seconds into the *Agrobacterium* solution. Afterwards the plants were kept in the growth chamber until seeds could be harvested. Transgenic seeds were selected by plating surface sterilized seeds on growth medium (4.4 g/L MS salts [Sigma-Aldrich], 1 g/L MES [Duchefa], 20 g/L sucrose, 6 g/L Phytagar supplemented with 5 mg/L glufosinate for plants carrying the bar resistance marker, 100 nM Pursuit for plants comprising an expression cassette for the AtAHAS gene, 50 mg/L kanamycin for plants carrying the nptII resistance marker, or 0.3 to 30 mM D-amino acids (as described below) for plants comprising an expression cassette for the dao1 gene from *Rhodotorula gracilis*. Surviving plants were transferred to soil and grown in the greenhouse. A sample of surviving plants were stained using GUS assay solution (Jefferson 1987) (0.4M $NaH_2PO_4$—$H_2O$ pH7.0, 0.5M EDTA, 0.01% TritonX-100, 250 mg/L X-glucuronidase (Fermentas)) overnight at 37° C. and observed for GUS expression (FIG. 10).

Lines containing a single T-DNA insertion locus are selected by statistical analysis of T-DNA segregation in the T2 population that germinated on medium comprising the appropriate selection agent. Plants with a single locus of Inserted T-DNA are grown and self-fertilized. Homozygous T3 seed stocks are then identified by analyzing T-DNA segregation in T3 progenies and confirmed to be expressing the introduced gene by northern blot analyses.

Example 4c

Agrobacterium-Mediated Transformation of Brassica napus

Disarmed *Agrobacterium* strain K599 (pRi2659Δ) transformed with the plasmid of interest (such as pBPSMM192b) is grown in 50 mL YEB medium (see Example 4a) at 28° C. overnight. The *Agrobacterium* solution is mixed with liquid co-cultivation medium (double concentrated MSB5 salts (Duchefa), 30 g/L sucrose (Duchefa), 3.75 mg/LI BAP (6-benzylamino purine, Duchefa), 0.5 g/L MES (Duchefa), 0.5 mg/L GA3 (Gibberellic Acid, Duchefa); pH5.2) until $OD_{650}$ of 0.5 is reached. Petiols of 4 days old seedlings of *Brassica napus* cv. Westar grown on growth medium B (MSB5 salts (Duchefa), 3% sucrose (Duchefa), 0.8% oxoidagar (Oxoid GmbH); pH 5.8) are cut. Petiols are dipped for 2-3 seconds in the *Agrobacterium* solution and afterwards put Into solid medium for co-cultivation (co-cultivation medium supplemented with 1.6% Oxoidagar). The co-cultivation lasts 3 days (at 24° C. and about 50 μMol/m²s light intensity). Afterwards petiols are transferred to co-cultivation medium supplemented with the appropriate selection agent (18 mg/L kanamycin (Duchefa) for plants comprising the nptII marker kanamycin for plants carrying the nptII resistance marker, or 0.3 to 30 mM D-amino acids; as described below) for plants comprising an expression cassette for the dao1 gene from *Rhodotorula gracilis*) and 300 mg/L Timentin (Duchefa)

Transformed petioles are incubated on the selection medium for four weeks at 24° C. This step is repeated until shoots appear. Shoots are transferred to A6 medium (MS salts (Sigma Aldrich), 20 g/L sucrose, 100 mg/L myo-inositol (Duchefa), 40 mg/L adeninesulfate (Sigma Aldrich), 500 mg/L MES, 0.0025 mg/L BAP (Sigma), 5 g/L oxoidagar (Oxoid GmbH), 150 mg/L timetin (Duchefa), 0.1 mg/L IBA (indol butyric acid, Duchefa); pH 5.8) supplemented with the appropriate selection agent (18 mg/L kanamycin (Duchefa) for plants comprising the nptII marker kanamycin for plants carrying the nptII resistance marker, or 0.3 to 30 mM D-amino acids; as described below) until they elongated. Elongated shoots are cultivated in A7 medium (A6 medium without BAP) for rooting. Rooted plants are transferred to soil and grown in the greenhouse.

Example 4d

Agrobacterium-Mediated Transformation of Tomato

In Vitro Seed Germination

Tomato seeds are sterilized in 10% Clorox™ (5.25% sodium hypochlorite) containing 0.1% Tween 20 for 15 with swirling. The sterilized seeds are rinsed 4-5 times with sterile distilled water. After sterilization, the seeds are transferred onto germination medium [0.25× MS, 7.5 g/L Sucrose, 0.7% Purified Agar (Sigma), pH 5.8] in 25×100 mm Petri dishes. The Petri dish containing seeds are placed in the dark for 2-3 days to get uniform sprouting and transferred to the culture room under light in culture room (25° C., 16/8 hour photoperiod, light intensity of 70 μE/m²s). Cotyledones of approximately 8 day-old seedlings are used for *Agrobacterium*-mediated transformation.

*Agrobacterium* Preparation

The disarmed *Agrobacterium* strain K599 (SHA001) carrying the binary vector pBPSEW008 [p-NOS::c-bar:t-NOS p-PcUBI::c-gusINT::t-NOS] (SEQ ID NO: 15) or pBPSMM192b [p-AtAhas::c-csr1-2::t-AtAHASpA t-NOS:: c-gusINT::p-SUPER] (SEQ ID NO: 16) was streaked onto solid YEP [10 g/L Bacto-peptone (Difco; Becton, Dickinson, and Co., Cockeysville, Md., USA), 5 g/L Yeast-extract (Difco), 5 g/L NaCl, 50 mg/L kanamycin, 1.2% granulated agar (Difco) solid only; pH 7.0] and incubated at 25° C. for 2 days. A single colony was picked with a sterile toothpick and placed in 50 mL of liquid YEP with antibiotics and shaken (175 rpm) at 25° C. for 16 h. After reaching an $OD_{650}$ 0.8 to 1.0, 15% glycerol working stocks were made and stored at minus 80° C. One day before explant inoculation, working stocks (depends on growth and stock concentration of *Agrobacterium*, anywhere between 5 μL to 50 μL) of *Agrobacterium* plus 50 mg/L kanamycin were added to YEP liquid medium in an Erlenmeyer flask. The flasks were shaken overnight at 25° C. until the $OD_{650}$ reached 0.8. Before preparing the tomato explants, the *Agrobacterium* was pelleted by centrifugation for 10 min at 5,500×g at 20° C. and resuspended in liquid co-cultivation medium [1/10× B5 major salts, 1/10× B5 minor salts, 1/10× MSIII iron, 1× B5 vitamins, 3% sucrose, 20 mM MES, 200 μM acetosyringone, 0.72 μM $GA_3$, 7.5 μM BAP; pH 5.4] to the desired density (e.g. $OD_{650}$ 0.5) and incubated at room temperature 30 min.

Explant Preparation

The cotyledons are removed from approximately 8 day old seedlings and placed onto sterile Petri dish. The both ends of the cotyledons are removed and cut in a half transversely, transferred onto sterile filter paper adaxial-side down, and placed onto the pre-cultured medium [MS salts and vitamins, 16 g/L glucose, 0.1 mg/L NAA, 1 mg/L BAP, 0.7% purified agar, pH 5.8] for two days in the dark at 22° C.

Co-Cultivation

The filter paper with the explants are placed onto the co-cultivation medium [MS salts and vitamins, 16 g/L glucose, 0.1 mg/L NAA, 1 mg/L BAP, 0.7% purified agar, 150 μM acetosyringone, pH 5.8] and inoculated with *Agrobacterium* suspension (0.3-0.5 at $OD_{650}$) for two to three days in the dark at 22° C.

Selection and Plant Regeneration

The end of the third day, the explants are placed abaxial-side down on the recovery medium (1× MS salts and vitamins, 16 g/L glucose, 2 mg/L zeatin, 0.7% purified agar, 200 mg/L timentin) for one week at 25° C. in the culture room (70 μE/m²s). After recovery, the explants are transferred onto the selection/regeneration medium (1× MS salts and vitamins, 30 g/L sucrose, 2 mg/L zeatin, 0.7% purified agar, 200 mg/L timentin, 50-100 nM Pursuit, pH 5.8) for 2.5 weeks. Shoot buds in the calli are excised from the cotyledons and transferred onto the elongation medium (1× MS salts and vitamins, 20 g/L sucrose, 0.5 mg/L zeatin or 0.25 mg/L IBA, 0.7% purified agar, 200 mg/L timentin and 50-100 nM Pursuit) for 2-3 weeks. The elongating shoots are excised from the calli and placed onto the rooting medium (1× MS salts and vitamins, 20 g/L sucrose, 0.25 mg/L IBA, 0.7% purified agar, 100 mg/L timentin, 50 nM Pursuit, pH 5.8) for 2-3 weeks until the plantlets are ready for transplanting to soil.

GUS Histochemical Assays

Leaf explants were assessed for GUS activity placing in GUS histochemical stain [80 mM $Na_2HPO_4$ (pH 8.0), 8 mM $Na_2EDTA$, 0.8% (v/v) Triton-X, 1.6% (v/v) dimethyl sulfoxide, 20% (v/v) methanol, 0.38 mM $K_4Fe(CN)_6$, 1 mM X-glucuro CHA salt (Inalco, Milan, Italy)] for 1 day at 37° C., after which the leaf tissue was washed in 70% (v/v) ethanol and cleared in 95% ethanol (Jefferson et al. 1987, Kosugi et al. 1990).

Transgenic tomato plantlets were obtained using disarmed *Agrobacterium* strain K599 (SHA001) containing pBPSMM192b (SEQ ID NO: 16) (see FIG. 5).

Example 4e

Agrobacterium-Mediated Transformation of Zea mays

Seeds of certain corn inbred lines or corn hybrid lines are germinated, rooted, and further grown in greenhouses. Ears from corn plants are harvested 8 to 14 (average 10) days after pollination (DAP) and immature embryos are isolated therefrom. Timing of harvest varies depending on growth conditions and maize variety. The optimal length of immature embryos for transformation is about 1 to 1.5 mm, including the length of the scutellum. The embryo should be translucent, not opaque. The excised embryos are collected in MS based liquid medium (comprising 1.5 mg/L 2,4-D). Acetosyringone (50 to 100 μM) is added to the medium at either the same time as inoculation with Agrobacterium or right before use for Agrobacterium infection.

Preparation of Agrobacterium: Agrobacterium strain SHA017 (K599 [pRi2659Δ]) transformed with the plasmid of interest (pSB1/pBPSMM232; this plasmid is a chimeric plasmid resulting from fusion of pBPSMM232 (SEQ ID NO: 17 [p-ZmUbi1::c-ZmAHASL/Xi12::t-ZmAHAS t-NOS::c-gus-INT::p-ZmUbi1]) with pSB1 (Komari 1996) are grown on YEP medium. The Agrobacterium suspension is vortexed in the above indicated medium (comprising 100 μM acetosyringone media for preferably 1-2 hours prior to infection).

Inoculation/Co-cultivation: The bacterial suspension is added to the microtube (plate) containing pre-soaked immature embryos and left at room temperature (20-25° C.) for 5 to 30 minutes. Excess bacterial suspension is removed and the immature embryos and bacteria in the residue medium are transferred to a Petri plate. The immature embryos are placed on the co-cultivation medium with the flat side down (scutellum upward). The plate is sealed, and incubated in the dark at 22° C. for 2-3 days. (Co-cultivation medium: MS-base, 1.5 mg/l 2,4-D, 15 μM AgNO$_3$, 100 μM acetosyringone). Alternatively, excised immature embryos are directly put on the co-cultivation medium with the flat side down (scutellum upward). Diluted Agrobacterium cell suspension is added to each immature embryo. The plate is sealed, and incubated in the dark at 22° C. for 2-3 days.

Recovery: After co-cultivation the embryos are transferred to recovery media (MS-base comprising 1.5 mg/L 2,4-D, 150 mg/L Timentin), and incubate the plates in dark at 27° C. for about 5 to 7 days the scutellum side up.

Selection of transformed calli: The immature embryos are transferred to selection media (recovery medium further comprising the selective agent e.g., D-alanine in concentration of 0.3 to 30 mM) (scutellum up) and incubated in the dark at 27° C. for 10-14 days (First selection). All immature embryos that produce variable calli are subcultured to 2-3$^{rd}$ selection media. At this stage, any roots that have formed are removed. Incubation occurs for 2 weeks under the same conditions for the first selection (Second selection). The regenerable calli is excised from the scutellum (the regenerable calli is whitish in color, compact, not slimy and may have some embryo-like structures) and transferred to fresh 2-3$^{rd}$ selection media. Plates are wrapped and incubate in the dark at 27° C. for 2 weeks (3$^{rd}$ selection may not be necessary for most of the genotypes, regenerable calli can be transferred to Regeneration medium).

Regeneration of transformed plants: Proliferated calli (whitish with embryonic structures forming) are excised in the same manner as for 2$^{nd}$/3$^{rd}$ selection and transferred to regeneration media (like selection medium but without 2,4-D). Plates are wrapped and put in the light (ca. 2,000 lux) at 25 or 27° C. for 2 weeks, or until shoot-like structures are visible. Transfer to fresh regeneration media if necessary. Calli sections with regenerated shoots or shoot-like structures are transferred to a Phytatray containing rooting medium and incubate for 2 weeks under the same condition as above step, or until rooted plantlets have developed. After 2 to 4 weeks on rooting media (half-concentrated MS medium, no 2,4-D, no selective agent), calli that still have green regions (but which have not regenerated seedlings) are transferred to fresh rooting Phytatrays. Rooted seedlings are transferred to Metromix soil in greenhouse and covered each with plastic dome for at least 1 week, until seedlings have established. When plants reach the 3-4 leaf-stages, they are fertilized with Osmocote and then sprayed with selective agent (e.g., D-alanine or D-serine), and grown in the greenhouse for another two weeks. Non-transgenic plants should develop herbicidal symptoms or die in this time. Survived plants are transplanted into 10" pots with MetroMix and 1 teaspoon Osmocote.

Example 5

Purification, Sequencing and Annotation of pRi2659Δ Plasmid

Agrobacterium strain SHA017 (disarmed Agrobacterium K599 [pRi2659Δ]) was grown in 5 liters of LB broth at 28° C. overnight. Total DNA was extracted according to a standard alkaline lysis protocol followed by phenol-chloroform extraction (Sambrook et al. 1989). pRi2659Δ plasmid DNA was isolated from the total DNA using pulsed-field gel electrophoresis (PFGE), with a CHEF-DRIII system (Bio-Rad Cat.#: 170-3695). The total DNA was loaded into an 1% pulsed-field certified agarose (Bio-Rad Cat #: 162-0137) gel in 0.5× TBE buffer (45 mM Tris-borate, 1 mM EDTA) followed by PFGE at 6 V/cm, with initial switch time of 1 second and final switch time of 25 seconds at 14° C. for 24 hrs. After electrophoresis, the gel strips containing the molecular marker lane and the edge of sample lane from both side of the gel were excised, stained with ethidium bromide (Sigma) and imaged. One visible band resolved was in the gel strips and the rest of DNA remained in the well. The single band was excised and recovered using electroelution according to Fu and Dooner (2000).

Recovered DNA was used as a template for PCR amplification with pRi-specific primers to confirm the recovery of pRi DNA. Primers were designed within conserved vir gene regions of pRi1724 (GenBank Accession # AP002086).

```
                                          (SEQ ID NO 27)
virG forward primer:  5'-TACTTCCTCC TCACGCACTC-3'

(SEQ ID NO 28)
virB reverse primer:  5'-GCCAGCAATG ATCAAGAATT TGTT
                      T-3'
```

Fragments of pRi could be generated via methods known to those skilled in the art, such as shotgun cloning. The Ri plasmid prep could be individually digested with various commercially available restriction enzymes, such as BamHI, SphI, EcoRI, HindIII (all available from new England Biolabs, Beverly, Mass.), and sub-cloned into a similarly digested pUC-type vector, such as pBlueScript (Stratagene, La Jolla, Calif.). Then, individual clones could be sequenced, and individual sequences assembled into contigs to generate the full sequence map as described below.

Purified pRi2659Δ was sequenced according to Margulies et al., (2005) and Sanger (1977). Vector sequence was masked using cross_match (Green © 1994-1999) and the cleaned raw sequence data was assembled according to Margulies et al., (2005) and CAP3 (Huang and Madan 1999). The remaining sequence gap was filled by PCR amplification and subsequent sequencing using the following primers:

```
                                          (SEQ ID NO 29)
PCR G109 forward primer: 5'-TTGGTGCGAC AACTCCTCGG
                            CG-3'

(SEQ ID NO 30)
PCR G112 reverse primer: 5'-GGTGAGCTCG ATCAGCTTCG
                            GC-3'
```

Sequencing reactions were performed on PCR products according to Sanger (1977). For final polishing, the draft sequence was divided into 100 fragments with each fragment having an overlap of 50 bases extended to its conjunction fragment; raw sequence reads highly identical to each fragment were pooled and re-assembled with CAP3 at a high stringency. These consensus sequences assembled from each fragment were assembled with CAP3 again to generate the sequence maps of pRi2659Δ (SEQ ID NO: 24), pRi2659Δtet (SEQ ID NO: 25), and pRi2659 (SEQ ID NO: 26) in Vector NTI (Invitrogen, Carlsbad Calif.). The new pRi2659 sequence was annotated using BLASTx at e-10 (Altschul et al. 1997) and GenBank Genpept protein data release version 148.

Example 6

Proteins Encoded by pRi2659Δ

The following table (Table 4) lists the proteins likely encoded by opening reading frames in the plasmid pRi2659Δ (SEQ ID NO: 24). The proteins SEQ ID NO are listed (SINo) and a detailed description of the encoded amino acid.

TABLE 4 pRi2659 Δ open reading frames and their protein SEQ ID NO (SINo)

| Feature | SINo | Details |
| --- | --- | --- |
| rcorf1 | 25 | similar to mll6374-like, integrase/recombinase [*Mesorhizobium loti* MAFF303099] |
| rcorf2 | 124 | similar to riorf1 in pRi1724, orf3 gene homolog in IS66 |
| rcorf3 | 123 | weakly similar to mlr6097, nitrogen assimilation control protein [*Mesorhizobium loti* MAFF303099], COG0583 [K] Transcriptional regulator |
| rcorf4 | 122 | N-term similar to STH1062, similar to glutamine ABC transporter ATP-binding protein [*Symbiobacterium thermophilum* IAM 14863]; C-term similar to bll6362, hypothetical protein in *Bradyrhizobium japonicum* USDA 110, COG2079 [R] Uncharacterized protein involved in propionate catabolism |
| rcorf5 | 121 | similar to Bcep02000339 [*Burkholderia fungorum* LB400], similar to blr3310, COG0765: ABC transporter permease protein [*Bradyrhizobium japonicum* USDA 110] |
| rcorf6 | 120 | similar to COG0765 [*Burkholderia fungorum* LB400], similar to PSPTO5181, cystine ABC tranporter, permease protein, putative [*Pseudomonas syringae* pv. tomato str. DC3000] |
| rcorf7 | 119 | similar to COG0834 *Burkholderia fungorum* LB400 COG0834, similar to STH1060, glutamine ABC transporter substrate-binding protein [*Symbiobacterium thermophilum* IAM 14863] |
| rcorf8 | 118 | similar to *A. tumefaciens* C58 hydantoin utilization protein hyuB |
| rcorf9 | 117 | similar to *A. tumefaciens* C58 hydantoin utilization protein hyuA |
| rcorf10 | 116 | similar to transcriptional regulatory protein [*Bradyrhizobium japonicum* USDA 110], helix_turn_helix gluconate operon transcriptional repressor |
| rcorf11 | 115 | similar to riorf40 in pRi1724, a hutH gene homolog, a cd01441: HAL; Histidine ammonia-lyase (HAL) catalyzes the first step in the degradation of histidine to glutamate |
| rcorf12 | 114 | weakly similar to riorf20 in pRi1724, similar to hypothetical protein Bcep02000338 [*Burkholderia fungorum* LB400]. |
| rcorf13 | 26 | weakly similar to riorf22 in pRi1724, similar to hypothetical protein Bcep02000337 [*Burkholderia fungorum* LB400] |
| rcorf14 | 27 | probable cucumbopine transporter gene, similar to riorf37 in pRi1724, a probable mikimopine transporter |
| rcorf15 | 164 | similar to SMa2207, a putative ABC transporter, ATP-binding protein [*Sinorhizobium meliloti* 1021], a COG3842: PotA; ABC-type spermidine/putrescine transport systems, ATPase components [Amino acid transport and metabolism] |
| rcorf16 | 28 | similar to SMa2205 *Sinorhizobium meliloti* 1021 (strain: 1021), a COG1176 [E] ABC-type spermidine/putrescine transport system, permease component I |
| rcorf17 | 165 | probable cucumbopine transporter, similar to riorf34, a hypothetical protein [*Agrobacterium rhizogenes*] the probable mikimopine transporter gene |
| rcorf18 | 126 | similar to AGR_L_1821 hypothetical protein [*Agrobacterium tumefaciens* str. C58], a sdeB gene homolog, cd01298: ATZ_TRZ_like; TRZ/ATZ family contains enzymes from the atrazine degradation pathway and related hydrolases |
| rcorf19 | 29 | similar to hutI, imidazolone-5-propionate hydrolase [*Agrobacterium tumefaciens* str. C58], less similar to riorf39 in pRi1724, KEGG pathway: Histidine metabolism 00340. |
| rcorf20 | 30 | similar to riorf41 in pRi1724, a hypothetical protein |
| rcorf21 | 31 | similar to riorf42 in pRi1724, a hutU gene homolog, a urocanase, EC number 4.2.1.49 |
| rcorf22 | 32 | similar to protein of unknown function DUF886 [*Mesorhizobium* sp. BNC1] and less similar to riorf43 in pRi1724, similar to unknown gene next to hutR gene in *Pseudomonas putida* |

TABLE 4-continued pRi2659 Δ open reading frames and their protein SEQ ID NO (SINo)

| Feature | SINo | Details |
| --- | --- | --- |
| rcorf23 | 33 | similar C-term similar to IS30 family transposase |
| rcorf24 | 134 | similar to riorf51 in pRi1724, weakly similar to mtrR gene of the tetR bacterial regulatory family. |
| rcorf25 | 133 | similar to riorf52 in pRi1724, similar MCA2182 decarboxylase family protein [*Methylococcus capsulatus* str. Bath] |
| rcorf26 | 132 | probable idi gene, similar to riorf53 in pRi1724, similar to idi, isopentenyl-diphosphate delta-isomerase [*Mycobacterium tuberculosis* CDC1551] EC 5.3.3.2. |
| rcorf27 | 131 | probable trans-zeatin synthase, similar to riorf54 in pRi1724, EC 2.5.1.—. |
| rcorf28 | 130 | probable GALLS gene, similar to riorf55 in pRi1724, complements virE2, unknow mechanism, required for efficient stable plant transformation. |
| rcorf29 | 166 | similar to riorf57 in pRi1724, a eutC homolog, ethanolamine ammonia-lyase light chain |
| rcorf30 | 129 | similar to riorf58 in pRi1724, a eutB homolog, ethanolamine ammonia-lyase heavy chain |
| rcorf31 | 128 | similar riorf59 in pRi1724, similar to orf3 gene in *Methylobacterium extorquens*, COG3931 [E] Predicted N-formylglutamate |
| rcorf32 | 34 | similar to riorf60 in pRi1724, similar to gatA-1 gene [Glutamyl-tRNA amidotransferase, subunit A (gatA-1) *Sulfolobus solfataricus* P2] |
| rcorf33 | 167 | similar to riorf61 in pRi1724, hypothetical ABC-transporter gene similar to PH0807, pfam00496: SBP_bac_5; Bacterial extracellular solute-binding proteins, family 5 |
| rcorf34 | 35 | similar to riorf62 in pRi1724, hypothetical ABC-transporter gene similar to agaB gene, agropinic acid permease, pfam00528: BPD_transp_1; Binding-protein-dependent transport system inner membrane component |
| rcorf35 | 36 | similar to riorf63 in pRi1724, hypothetical ABC-transporter gene similar to dppC gene, pfam00528: BPD_transp_1; Binding-protein-dependent transport system inner membrane component |
| rcorf36 | 37 | similar to riorf64 in pRi1724, hypothetical ABC-transporter gene similar to moaD gene, mannopinic acid permease, COG1123: ATPase components of various ABC-type transport systems. |
| rcorf37 | 38 | similar to riorf66 in pRi1724, similar to amaB gene, N-carbamoyl-beta-alanine amidohydrolase |
| rcorf38 | 168 | similar to riorf67 in pRI1724, weakly similar to pck gene, smart00587: CHK; ZnF_C4 abd HLH domain containing kinases domain |
| rcorf39 | 39 | similar to riorf68 in pRi1724, weakly similar to pck gene, pfam01633: Choline_kinase; Choline/ethanolamine kinase |
| rcorf40 | 40 | similar to riorf69 in pRi1724, similar to MLCB1779.29 (probable monophosphatase gene) in *Mycobacterium leprae*, cd01641: Bacterial_IMPase_like_1; Predominantly bacterial family of Mg++ dependend phosphatases, related to inositol monophosphatases |
| rcorf41 | 41 | similar to riorf71 in pRi1724, hypothetical chemoreceptor gene similar to orf2 gene in pTi15955 |
| rcorf42 | 137 | similar to riorf73 in pRi1724, hypothetical repressor gene, similar to SMa2004 [*Sinorhizobium meliloti* 1021], putative ROK-family transcriptional regulator. |
| rcorf43 | 136 | similar to riorf73 in pRI1724, similar to SMa2002 [*Sinorhizobium meliloti* 1021], COG2755 [E] Lysophospholipase L1 and related esterases. |
| rcorf44 | 42 | similar to riorf74, similar to teuB (periplasmic sugar binding protein) gene, COG1879: RbsB; ABC-type sugar transport system, periplasmic component [Carbohydrate transport and metabolism]. |
| rcorf45 | 43 | similar to riorf75 in pRi1724, similar to teuA (ATP-binding sugar ABC transporter) gene, hypothetical ABC-transporter gene, COG1129: MgIA; ABC-type sugar transport system, ATPase component [Carbohydrate transport and metabolism]. |
| rcorf46 | 44 | similar to riorf76 in pRi1724, similar to teuC1 (sugar ABC transporter-permease) gene, a hypothetical ABC-transporter gene, pfam02653: BPD_transp_2; Branched-chain amino acid transport system/permease component. |
| rcorf47 | 45 | similar to riorf77 in pRi1724, similar to teuC2 (sugar ABC transporter-permease) gene, a hypothetical ABC-transporter gene, pfam02653: BPD_transp_2; Branched-chain amino acid transport system/permease component. |
| rcorf48 | 46 | similar to riorf78 in pRi1724, a COG2755 [E] Lysophospholipase L1 and related esterases. |
| rcorf49 | 169 | similar to riorf79 in pRi1724, a glpK (glycerol kinase) gene homolog, EC 2.7.1.30. |
| rcorf50 | 47 | similar to riorf80 of pRi1724, a glpD gene homolog, glycerol-3-phosphate dehydrogenase [*Agrobacterium tumefaciens* str. C58] |
| rcorf51 | 48 | similar to riorf81 in pRi1724, a acs(acetyl-CoA synthetase) gene homolog, EC 6.2.1.1. |
| rcorf52 | 49 | similar to riorf82 of pRi1724, a adk gene homolog, pfam00406: ADK; Adenylate kinase, EC 2.7.4.3. |
| rcorf53 | 50 | similar to riorf83 in pRi1724, a hypothetical chemoreceptor gene similar to orf2 gene in pTi15955 |

TABLE 4-continued pRi2659 A open reading frames and their protein SEQ ID NO (SINo)

| Feature | SINo | Details |
| --- | --- | --- |
| rcorf54 | 51 | similar to riorf84, a cbbF gene homolog, a cd00354: FBPase; Fructose-1,6-bisphosphatase, an enzyme that catalyzes the hydrolysis of fructose-1,6-biphosphate into fructose-6-phosphate and is critical in gluconeogenesis pathway. |
| rcorf55 | 52 | cbbA gene homolog, a cd00947: TBP_aldolase_IIB; Tagatose-1,6-bisphosphate (TBP) aldolase and related Type B Class II aldolases |
| rcorf56 | 53 | similar to pdb Chain A, Yeast Triosephosphate Isomerase (tri1) |
| rcorf57 | 54 | similar to riorf88 in pRi1724 and to phrR gene, DNA binding protein, helix-turn-helix XRE family. |
| rcorf58 | 55 | similar to riorf89 in pRi1724 and to thcR gene, conserved domain, HTH_ARAC; helix_turn_helix, arabinose operon control protein |
| rcorf59 | 56 | similar to riorf90 in pRi1724 and Atu6096 in pTiC58, conserved in *Mesorhizobium* and *Agrobacterium* species. |
| rcorf60 | 57 | similar to riorf91 in pRI1724, also similar to several hypothetical proteins in *Agrobacterium*, *Mesorhizobium* and *Nitrobacter* species. |
| rcorf61 | 58 | similar to riorf92 in pRi1724, hypothetical protein conserved in several *Agrobacterium* and *Mesorhizobium* strains. |
| rcorf62 | 59 | similar to riorf93, similar to jhp0928 gene in *Helicobacter pylori*, a COG0827; Adenine-specific DNA methylase [DNA replication, recombination, and repair]. |
| rcorf63 | 60 | similar to AGR_pTi_191 partitioning protein *Agrobacterium tumefaciens* str. C58, partitioning protein, COG1475 [K] Predicted transcriptional regulators. |
| rcorf64 | 61 | similar to hypothetical protein MesoDRAFT_1041 [*Mesorhizobium* sp. BNC1], conserved in *Agrobacterium*, *Mesorhizobium*, and *Nitrobacter* speices. |
| rcorf65 | 170 | similar riorf95 in pRI1724, similar to downstream region of nylA gene in pOAD2. |
| rcorf66 | 62 | similar to hypothetical protein MesoDRAFT_1043 [*Mesorhizobium* sp. BNC1], conserved in *Agrobacterium*, *Mesorhizobium*, and *Nitrobacter* species. |
| rcorf67 | 63 | similar to riorf96 in pRi1724, a hypothetical protein weakly similar to down-stream region of hydL gene in *Thiocapsa roseopersicina*. |
| rcorf68 | 64 | similar to AGR_pTi_204 [*Agrobacterium tumefaciens* str. C58] and argG, argininosuccinate synthase, from *Streptomyces clavuligerus*. |
| rcorf69 | 65 | similar to riorf100 in pRi1724, similar to ardC gene in pSa(IncW plasmid) COG4227, probable conjugal transfer protein (antirestriction protein). |
| rcorf70 | 66 | similar to riorf101 in pRI1724, similar to mll9093 aspartate 1-decarboxylase [*Mesorhizobium loti* MAFF303099] and pgi gene in *Xanthomonas citri*, COG0853 [H] Aspartate 1-decarboxylase. |
| rcorf71 | 67 | similar to similar to riorf106 in pRi1724, similar to a teuB gene in pRtrCFN299a, a COG1879: RbsB; ABC-type sugar transport system, periplasmic component [Carbohydrate transport and metabolism]. |
| rcorf72 | 68 | similar to riorf107 in pRi1724, similar to mcpC (mcpC gene in *Rhizobium*) gene in *Rhizobium leguminosarum*, a smart00283: MA; Methyl-accepting chemotaxis-like domains (chemotaxis sensory transducer). |
| rcorf73 | 171 | similar to AGR_pTi_225 nuclease [*Agrobacterium tumefaciens* str. C58], a COG1525 [L] Micrococcal nuclease (thermonuclease) homologs. |
| rcorf74 | 140 | probable traG gene, similar to riorf109 in pRi1724, a cd01126: TraG_VirD4; The TraG/TraD/VirD4 family are bacterial conjugation proteins. |
| rcorf75 | 172 | probable traD gene, conjugal transfer protein similar to riorf110 in pRi1724. |
| rcorf76 | 139 | probable traC gene, Ti plasmid conjugal DNA processing, similar to riorf111 in pRi1724. |
| rcorf77 | 69 | probable traA gene, similar to riorf112 in pRi1724, COG0507: RecD; ATP-dependent exoDNAse (exonuclease V), alpha subunit —helicase superfamily I member [DNA replication, recombination, and repair]. |
| rcorf78 | 173 | probable traF gene, similar to riorf113 in pRi1724, COG4959: TraF; Type IV secretory pathway, protease TraF [Posttranslational modification, protein turnover, chaperones/Intracellular trafficking and secretion]. |
| rcorf79 | 70 | probable traB gene, similar to riorf114 in pRi1724. |
| rcorf80 | 71 | similar to riorf115 in pRi1724, a hypothetical protein of *Agrobacterium rhizogenes* (strain: MAFF03-01724) |
| rcorf81 | 174 | similar to riorf117 in pRi1724, a hypothetical protein or *Agrobacterium rhizogenes* (strain: MAFF03-01724), a cd00093: HTH_XRE; Helix-turn-helix XRE-family like proteins. |
| rcorf82 | 72 | probable traM gene similar to riorf118 in pRi1724, TraR antagonist. |
| rcorf83 | 152 | probable traR gene similar to riorf119 in pRi1724 and traR/AGR pTi 249 in pTiC58. |
| rcorf84 | 151 | probable trbI gene similar to riorf120 in pRi1724, a pfam03743: TrbI; Bacterial conjugation TrbI-like protein. |
| rcorf85 | 150 | probable trbH gene similar to riorf121 in pRi1724, Type IV transfer system required for Ri/Ti plasmid conjugation. |
| rcorf86 | 149 | probable trbG gene similar to riorf122 in pRi1724, Type IV transfer system required for Ri/Ti plasmid conjugation. |
| rcorf87 | 148 | probable trbF gene similar to riorf123 in pRi1724, Type IV transfer system required for Ri/Ti plasmid conjugation. |
| rcorf88 | 147 | probable trbF gene similar to riorf123 in pRi1724, Type IV transfer system required for Ri/Ti plasmid conjugation. |
| rcorf89 | 146 | trbK gene homolog similar to riorf125 in pRi1724, Type IV transfer system required for Ri/Ti plasmid conjugation. |

TABLE 4-continued pRi2659 Δ open reading frames and their protein SEQ ID NO (SINo)

| Feature | SINo | Details |
|---|---|---|
| rcorf90 | 175 | probable trbJ gene similar to riorf126 in pRi1724, Type IV transfer system required for Ri/Ti plasmid conjugation, COG5314; Conjugal transfer/entry exclusion protein [Intracellular trafficking and secretion]. |
| rcorf91 | 145 | probable trbE gene similar to riorf127 in pRi1724, Type IV transfer system required for Ri/Ti plasmid conjugation. |
| rcorf92 | 176 | probable trbD gene similar to riorf128 in pRi1724, Type IV transfer system required for Ri/Ti plasmid conjugation. |
| rcorf93 | 144 | probable trbC gene similar to riorf129 in pRi1724, Type IV transfer system required for Ri/Ti plasmid conjugation. |
| rcorf94 | 143 | probable trbB gene similar to riorf130 in pRi1724, Type IV transfer system required for Ri/Ti plasmid conjugation. |
| rcorf95 | 142 | probable traI gene similar to riorf131 in pRi1724, a LuxI-type quorum sensing regulators, synthesizes 3-oxooctanoylhomoserine lactone, a pfam00765: Autoind_synth; Autoinducer synthetase. |
| rcorf96 | 73 | probable repA gene similar to riorf132 *Agrobacterium rhizogenes* (strain: MAFF03-01724), a cd00550: ArsA_ATPase; Oxyanion-translocating ATPase (ArsA) and cd00592: HTH_MERR; Helix-turn-helix transcription regulator MERR, N-terminal domain. |
| rcorf97 | 74 | probable repB gene similar to riorf133 in pRi1724, a smart00470: ParB; ParB-like nuclease domain protein. |
| rcorf98 | 75 | probable repC gene similar to riorf134 in pRi1724, essential for vegetative replication. |
| rcorf99 | 76 | similar to riorf135 in pRi1724, weakly similar to y4aO gene in pNGR234a. |
| rcorf100 | 156 | similar to C-term of pAT 22 *Agrobacterium tumefaciens* str. C58 (strain: C58, isolate: Cereon), a COG0582 [L] Integrase protein. |
| rcorf101 | 155 | similar to N-term. fragment of pAT 22 *Agrobacterium tumefaciens* str. C58 (strain: C58, isolate: Cereon), a COG0582 [L] Integrase protein. |
| rcorf102 | 154 | similar to hypothetical integrase gene orf2 (similar to *Pseudomonas* integrase-like gene) in pTiA6NC. |
| rcorf103 | 77 | similar to riorf137 gene in pRi1724 and orf4 gene in pTiA6NC. |
| rcorf104 | 177 | similar to riorf138 in pRi1724 and gvp1 gene in pHH1, a pfam04079: DUF387; Putative transcriptional regulators (Ypuh-like) protein. |
| rcorf105 | 78 | similar to riorf139 in pRi1724, similar to uncharacterized region between y4jF and y4jG genes in pNGR234a. |
| rcorf106 | 79 | similar riorf140 in pRi1724 and to orf300 gene in *Escherichia coli*, a pfam00004: AAA; ATPase family associated with various cellular activities (AAA). |
| rcorf107 | 80 | similar to N-term of riorf141 in pRi1724, a hypothetical protein. |
| rcorf108 | 178 | similar to C-term of riorf141 in pRi1724, a hypothetical protein. |
| rcorf109 | 81 | weakly similar to SERP1653 *Staphylococcus epidermidis* RP62A (strain: RP62A), a hypothetical protein. |
| rcorf110 | 82 | similar to riorf142 in pRi1724, similar to gene for luminal binding protein exon 6 in *Arabidopsis thaliana*. |
| rcorf111 | 83 | similar to riorf143 in pRi1724 and to spdB3 gene in pSG5. |
| rcorf112 | 84 | similar to riorf144 in pRi1724. |
| rcorf113 | 179 | weak similar over 79 aa to blr8180 of *Bradyrhizobium japonicum* USDA 110 (strain: USDA 110), a COG1760 [E] L-serine deaminase. |
| rcorf114 | 85 | putative virF gene, similar to riorf146 in pRI1724 and tiorf133 in pTiSAKURA. |
| rcorf115 | 159 | similar to riorf147 in pRi1724 and y4mC gene in pNGR234a homolog, a vir induced gene. |
| rcorf116 | 158 | probable potassium uptake protein, similar to Atu0711 i*Agrobacterium tumefaciens* str. C58 and riorf148 in pRi1724 and to kup gene, a pfam02705: K_trans; K+ potassium transporter protein. |
| rcorf117 | 86 | similar to riorf149 in pRi1724, similar to N-term. aatA (atu2196) aspartate aminotransferase A [*Agrobacterium tumefaciens* str. C58]. |
| rcorf118 | 180 | similar to riorf150 in pRi1724, aatA gene in *Rhizobium leguminosarum* homolog, hypothetical pseudogene which is divided by frame-shift. |
| rcorf119 | 87 | probable virH, similar to riorf151 in pRi1724, cytochrome P450-type oxidase, likely type IV secreted protein via virB/D4. |
| rcorf120 | 88 | probable virA, similar to riorf152 in pRi1724, receptor in two component virA/G regulatory system. |
| rcorf121 | 89 | probable virB1, similar to riorf153 in pRi1724, type IV secretion system require for T-complex transfer. |
| rcorf122 | 181 | probable virB2, similar to riorf154 in pRi1724, type IV secretion system require for T-complex transfer. |
| rcorf123 | 90 | probable virB3, similar to riorf155 in pRi1724, type IV secretion system require for T-complex transfer. |
| rcorf124 | 182 | probable virB4, similar to riorf156 in pRi1724, type IV secretion system require for T-complex transfer. |
| rcorf125 | 91 | probable virB5, similar to riorf157 in pRi1724, type IV secretion system require for T-complex transfer. |
| rcorf126 | 92 | probable virB6, similar to riorf158 in pRi1724, type IV secretion system require for T-complex transfer. |
| rcorf127 | 93 | probable virB7, similar to riorf159 in pRi1724, type IV secretion system require for T-complex transfer. |

TABLE 4-continued pRi2659 A open reading frames and their protein SEQ ID NO (SINo)

| Feature | SINo | Details |
|---|---|---|
| rcorf128 | 183 | probable virB8, similar to riorf160 in pRi1724, type IV secretion system require for T-complex transfer. |
| rcorf129 | 94 | probable virB9, similar to riorf161 in pRi1724, type IV secretion system require for T-complex transfer. |
| rcorf130 | 184 | probable virB10, similar to riorf162 in pRi1724, type IV secretion system require for T-complex transfer. |
| rcorf131 | 95 | probable virB11, similar to riorf163 in pRi1724, type IV secretion system require for T-complex transfer. |
| rcorf132 | 96 | probable virG, similar to riorf164 in pRi1724, activator in two component virA/G regulatory system. |
| rcorf133 | 97 | hypothetical protein, similar to aa1-103 pf ISBm1 transposase orfB [*Brucella suis* 1330] (NP 697552). |
| rcorf134 | 163 | hypothetical protein, similar to aa4-122/142 of ISBm1 transposase orfA [*Brucella suis* 1330] (NP 697551). |
| rcorf135 | 162 | probable virC2, similar to riorf165 in pRi1724, T-DNA processing virulence virA/G regulated protein. |
| rcorf136 | 161 | probable virC1, similar to riorf166 in pRi1724, virulence virA/G regulated protein, AGR_pTi_18p; VirC1; binds to overdrive sequence adjacent to right border of T-DNA; increases the level of T-DNA processing. |
| rcorf137 | 98 | probable virD1, similar to riorf167 in pRi1724, a virA/G regulate T-DNA border endonuclease accessory protein. |
| rcorf138 | 99 | probable virD2, similar to riorf168 in pRi1724, the virA/G regulated T-DNA border endonuclease. |
| rcorf139 | 185 | probable virD3, similar to riorf169 in pRi1724, virA/G regulated, not required for virulence, possible host range factor. |
| rcorf140 | 100 | probable virD4, similar to riorf170 in pRi1724, virA/G regulated component of virB/D4 Type IV secretion system. |
| rcorf141 | 186 | probable virD5, similar to riorf171 in pRi1724, virA/G regulated component of virB/D4 Type IV secretion system. |
| rcorf142 | 101 | probable virF, similar to riorf172 in pRi1724, and less similar to tiorf133 in pTi-SAKURA, a type IV secretion protein via virB/D4 complex. |
| rcorf143 | 102 | probable virE3, similar to riorf173 in pRi1724 and virE3 in pRiA6NC, interacts with virE2 and IMPA1 (AtKAP-alpha) in *A. tumefaciens*, virB/D4 type IV secreted protein. |
| rcorf144 | 103 | similar to *Mesorhizobium loti* MAFF303099 mlr1626, predicted mannose-6-phosphate isomerase. |
| rcorf145 | 104 | similar to phage integrase |
| rcorf146 | 187 | similar to Y4rB *Rhizobium* sp. NGR234. |

REFERENCES

The references listed below and all references cited herein are incorporated herein by reference to the extent that they supplement, explain, provide a background for, or teach methodology, techniques, and/or compositions employed herein.
1. Abler et al. (1993) Plant Mol Biol 22: 1031-1038.
2. Atanassova et al. (1992) Plant J 2(3): 291-300.
3. Altschul et al. (1997) Nucl. Acids Res. 1997 25: 3389-3402.
4. Ausubel et al. (1987) Current Protocols in Molecular Biology, Greene Publishing Assoc. and Wiley Interscience
5. Baerson and Lamppa (1993) Plant Mol Biol 22(2): 255-67
6. Baker et al. (1987) EMBO J 6: 1547-1554
7. Bäumlein et al. (1992) Plant J 2(2): 233-239;
8. Bäumlein et al. (1991a) Mol Gen Genet 225(3): 459-467
9. Bäumlein et al. (1991b) Mol Gen Genet 225: 121-128
10. Belarmino et al. (2000) Plant Cell. Rep. 19: 435-442.
11. Benfey et al. (1989) EMBO J. 8: 2195-2202
12. Berger and Kimmel (1987) Guide to Molecular Cloning Techniques, Methods in Enzymology, Vol. 152, Academic Press, Inc., San Diego, CA (Berger)
13. Bevan et al. (1984) Nucl Acid Res 12, 8711-8720
14. Binding (1985) Regeneration of Plants, Plant Protoplasts, pp.21-73, CRC Press, Boca Raton
15. Bruce et al. (1989) Proc Natl Acad Sci USA 86: 9692-9696
16. Bush and Pueppke (1991) Appl. Environ. Microbiol. 57(9): 2468-2472
17. Bustos et al. (1989) Plant Cell 1(9): 839-53
18. Byrne et al. (1987) Plant Cell Tiss. Org. Cult. 8: 3-15
19. Chen and Winans (1991) J. Bacteriol. 173: 1139-1144
20. Chilton (1977) Cell 11: 263-271
21. Chilton et al. (1982) Nature 295: 432-434.
22. Cho et al. (2000) Planta 210: 195-204
23. Choi et al. (1995) Mol Gen Genet 246: 266-268
24. Christensen et al. (1989) Plant Mol. Biol. 12: 619-632
25. Christensen et al. (1992) Plant Mol Biol 18: 675-689
26. Christou (1995) Euphytica 85: 13-27.
27. Chui et al. (1996) Curr Biol 6: 325-330.
28. Clough and Bent (1998) Plant J. 16, 735-743.
29. Comai et al. (1990) Plant Mol Biol 15: 373-381
30. Combard et al (1987) Plasmid 18, 70-75
31. Conceicao et al. (1994) Plant 5: 493-505
32. Costantino et al. (1980) Gene 11(1-2): 79-87.
33. Cushman et al. (2000) Curr Opin Plant Biol 3(2): 117-24
34. Dale and Ow (1991) Proc Nat'l Acad Sci USA 88: 10558-10562

TABLE 4-continued pRi2659 A open reading frames and their protein SEQ ID NO (SINo)

Feature    SINo    Details

35. Dandekar et al. (1989) J Tissue Cult Meth 12: 145
36. Dasgupta et al. (1993) Gene 133: 301-302
37. de Block et al. (1987) EMBO J 6: 2513-2518
38. de Bruijn et al. (1996) Rep-PCR Genomic Fingerprinting of Plant-Associated Bacteria and Computer-Assisted Phylogenetic Analyses In: Biology of Plant-Microbe Interaction; Proceedings of the 8th International Congress of Molecular Plant-Microbe Interactions (G. Stacey, B. Mullin and P. Gresshoff, Eds.) APS Press, 497-502
39. De Cleene and De Layk (1976) Bot. Rev. 42 (4): 389-466
40. de Framond et al. (1983) Bio/Technol. 1: 262-269
41. Deikman et al. (1988) EMBO J 7: 3315-3320
42. Deikman et al. (1992) Plant Physiol 100: 2013-2017
43. Dellaporta et al. (1988) In: Chromosome Structure and Function: Impact of New Concepts, 18th Stadler Genetics Symposium, 11: 263-282
44. Dunwell (2000) J Exp Bot 51 Spec No: 487-96
45. Eady et al. (2000) Plant Cell. Rep. 19: 376-381.
46. Ebinuma et al. (2000a) Proc Natl Acad Sci USA 94: 2117-2121
47. Ebinuma et al. (2000b) Selection of Marker-free transgenic plants using the oncogenes (ipt, rol A, B, C) of Agrobacterium as selectable markers, In Molecular Biology of Woody Plants. Kluwer Academic Publishers
48. Eichholtz et al. (1987) Somatic Cell and Molecular Genetics 13, 67-76
49. EP-A1 0 120 516
50. EP-A1 0 270 615
51. EP-A1 0 333 033
52. EP-A1 0 335 528
53. EP-A1 0 375 091
54. EP-A1 0 388 186
55. EP-A1 0 409 625
56. EP-A1 0 807 836
57. Ermayanti et al. (1994) Phytochemistry 36: 313-317.
58. Evans et al. (1983) Protoplasts Isolation and Culture, Handbook of Plant Cell Culture, pp. 124176, Macmillian Publishing Company, New York
59. Farrand et al. (2003) Int. J. Systematic & Evolutionary Microbiology 53: 1681-1687
60. Fedoroff and Smith (1993) Plant J 3: 273-289
61. Fiedler et al. (1995) Biotechnology (NY) 13(10): 1090-1093.
62. Fire et al. (1998) Nature 391: 806-811
63. Fraley et al. (1983) Proc Natl Acad Sci USA 80: 4803
64. Franck et al. (1980) Cell 21: 285-294
65. Fu and Dooner (2000) Genome Research 10: 866-873.
66. Gallie et al. (1987) Nucl Acids Res 15: 8693-8711
67. Gardner et al. (1986) Plant Mol Biol 6: 221-228
68. Gatz et al. (1991) Mol Gen Genetics 227: 229-237
69. Gatz et al. (1994) Mol Gen Genetics 243: 32-38
70. Gatz et al. (1997) Annu Rev Plant Physiol Plant Mol Biol 48: 89-108
71. Gelvin et al. (Eds) (1990) Plant Molecular Biology Manual; Kluwer Academic Pub-lisher, Dordrecht, The Netherlands
72. Gelvin (2003) Microbiol Mol Biol Rev 67(1): 16-37
73. GenBank Acc. No. AP002086
74. GenBank Acc. No. J02798
75. GenBank Acc. No. J05212
76. GenBank Acc. No. L05934
77. GenBank Acc. No. M63985
78. GenBank Acc. No. U09118
79. GenBank Acc. No. U09119
80. GenBank Acc. No. U38846, nucleotides 3862 to 5325 or else 5342
81. GenBank Acc. No. U93215
82. GenBank Acc. No. X03677
83. GenBank Acc. No. Z17657
84. Gleave et al. (1999) Plant Mol Biol. 40(2): 223-35
85. Goodner et al. (2001) Science 294: 2323-2328.
86. Goodner et al. (1999) J. Bacteriol. 181: 5160-5166.
87. Gruber et al. (1993) "Vectors for Plant Transformation," in METHODS IN PLANT MOLECULAR BIOLOGY AND BIOTECHNOLOGY; pp.89-119.
88. Guerrero et al. (1993) Mol Gen Genet 224: 161-168
89. Hadi et al. (1996) Plant Cell Reports 15: 500-505
90. Hajdukiewicz et al. (1994) Plant Mol Biol 25: 989-994
91. Hamill et al. (1991) Plant Cell. Rep. 10: 221-224.
92. Hansen et al. (1994) Proc. Natl. Acad. Sci. USA 91: 7603-7607
93. Haseloff et al.(1997) Proc Natl Acad Sci USA 94(6): 2122-2127;
94. Hayford et al. (1988) Plant Physiol. 86: 1216
95. Hernalsteens et al. (1980) Nature 287: 654-656
96. Hershey et al. (1991) Mol Gen Genetics 227: 229-237
97. Hiei et al. (1994) Plant J 6: 271-282
98. Hildebrand (1934) J Agric Res 48: 857-885
99. Hille et al. (1986) Plant Mol. Biol. 7: 171 (1986)
100. Hoekema (1985) In: The Binary Plant Vector System, Offsetdrukkerij Kanters B.V., Alblasserdam, Chapter V
101. Hoekema et al. (1983) Nature 303: 179-181
102. Holsters et al. (1978) Mol Gen Genet 163: 181-187
103. Holtorf et al. (1995) Plant Mol Biol 29: 637-649
104. Hood et al. (1986) J. Bacteriol 168: 1291-1301
105. Hood et al. (1993) Transgenic Res. 2: 208-218,
106. Hood et al., (1986) J. Bacteriol. 168(3): 1283-1290

TABLE 4-continued pRi2659 Δ open reading frames and their protein SEQ ID NO (SINo)

Feature    SINo   Details

107. Hood et al. (1987)Plant Physiol. 83: 529-534
108. Horsch et al. (1985) Science 227: 1229-1231
109. Huang and Madan (1999) Genome Research, 9: 868-877.
110. Huffman et al. (1984) J Bacteriol. 157(1): 269-76
111. Ishida et al. (1996) Nature Biotech 745-750
112. Jahne et al. (1995). Euphytica 85: 35-44.
113. Jefferson (1987b) Plant Mol. Bio. Rep., 5: 387-405
114. Jefferson et al. (1987) EMBO J 6: 3901-3907
115. Jones et al.(1987) Mol. Gen. Genet. 210: 86
116. Joos et al.(1983) Cell 32: 1057-1067
117. Joseffson et al. (1987) J Biol Chem 262: 12196-12201
118. Jouanin (1984) Plasmid 12: 91-102
119. Jouanin (1986) Plasmid 6: 124-134
120. Kado (1991) Crit Rev Plant Sci 10: 1
121. Keane et al. (1970) Aust. J. Biol. Sci. 23: 585-595
122. Klee et al. (1987) Ann Rev Plant Physiol 38: 467-486
123. Komari et al. (1996) The Plant Journal 10(1): 165-174
124. Koncz and Schell (1986) Mol Gen Genet 204: 383-396
125. Koprek et al. (1999) Plant J 19(6): 719-726
126. Kosugi et al. (1990) Plant Sci 70: 133-140
127. Kouchi et al. (1999) Plant J 18(2) 121-129
128. Lahners (1984) Plasmid 11: 130-140
129. Lam and Chua (1991) J Biol Chem 266(26): 17131-17135
130. Lam et al. (1984) Plant Sci. Lett. 34: 345-352.
131. Last et al. (1991) Theor. Appl. Genet. 81, 581-588
132. Lawson et al. (1994) Mol Gen Genet 245: 608-615
133. Lee et al. (1994) Plant Mol Biol 26: 1981-1987
134. Leffel et al. (1997) Biotechniques. 23(5): 912-8
135. Lepetit et al. (1992) Mol. Gen. Genet. 231: 276-285
136. Lincoln et al. (1988) Proc Natl Acad Sci USA 84: 2793-2797
137. Ling et al. (1998) Plant Cell Reports 17: 843-847
138. Llob et al. (2003) Europ J Plant Pathol 109: 381-389
139. Lohmer et al. (1993) Plant Cell 5: 65-73
140. Ludwig et al. (1990) Science 247: 449
141. Lysnik et al. (1993) NAR 21: 969-975
142. Maniatis T, Fritsch EF and Sambrook J (1989) Molecular Cloning: A Laboratory Manual, 2nd Ed., Cold Spring Harbor Laboratory, Cold Spring Harbor (NY)
143. Margulies et al. (2005) Nature (advanced online publication) doi: 10.1038/nature03959.
144. Matzke and Chilton (1981) J. Mol. Appl. Genet. 1: 39-49
145. Matzke et al. (2000) Plant Mol Biol 43: 401-415
146. McCormick et al. (1986) Plant Cell Reports, 5: 81-84
147. McElroy et al. (1990) Plant Cell 2: 163171
148. McGranahan et al. (1990) Plant Cell Rep 8: 512
149. Melchers et al. (2000) Curr Opin Plant Biol 3(2): 147-52
150. Mett et al. PNAS 90: 4567-4571 (1993)
151. Miki et al. (1993) "Procedures for Introducing Foreign DNA into Plants" in METH-ODS IN PLANT MOLECULAR BIOLOGY AND BIOTECHNOLOGY; pp.67-88
152. Millar et al. (1992) Plant Mol Biol Rep 10: 324-414
153. Mol et al. (1990) FEBS Lett 268(2): 427-430
154. Moloney et al. (1989) Plant Cell Reports 8: 238
155. Mooreet al. (1979) Plasmid 2(4): 617-26.
156. Mozo and Hooykaas (1991) Plant Mol. Biol. 16: 917-918.
157. Murai et al. (1983) Science 23: 476-482
158. Murashige and Skoog (1962) Physiol. Plant. 15, 472-497. (472/473)
159. Naested (1999) Plant J 18: 571-576
160. Narayanan et al. (1999) Crop Sci 39: 1680-1686;
161. Nester (1984) Ann Rev Plant Physiol 35: 387-413
162. Nilsson and Olsson (1997) Phys. Plantarium 100, 463-473
163. Odell et al. (1985) Nature 313: 810-812
164. Odell et al. (1990) Mol Gen Genet 223: 369-378
165. Olhoft and Somers (2001) Plants Cell Reports 20: 706-711
166. Otten et al. (1984) Mol. Gen. Genet. 195: 159-163
167. Ow et al. (1986) Science 234: 856-859
168. Peralto and Ream (1985) Proc. Natl. Acad. Sci. (USA)
169. Perera et al. (1993) Plant Mol. Biol 23(4): 793-799
170. Prasher et al. (1985) Biochem Biophys Res Commun 126(3): 1259-1268
171. Randez-Gil et al. (1995) Yeast 11: 1233-1240
172. Reichel et al.(1996) Proc Natl Acad Sci USA 93(12): 5888-5893
173. Rouster et al. (1998) Plant J 15: 435-440
174. Saijo et al. (2000) Plant J 23(3): 319-327
175. Saitou et al. (1987) Mol Biol. Evol 4: 406-425
176. Sakamoto et al. (2000) J Exp Bot 51(342): 81-8
177. Sambrook et al. (1989) Cold Spring Harbor Laboratory Press; ISBN 0-87969-309-6
178. Sanger et al. (1977) Proc Natl Acad Sci USA 74: 5463-5467
179. Sauer (1998) Methods 14(4): 381-92
180. Sawada et al. (1993) International Journal of Systematic Bacteriology 43(4): 694-702.
181. Scheeren-Groot et al. (1994) J. Bacteriol 176: 6418-6426

TABLE 4-continued pRi2659 Δ open reading frames and their protein SEQ ID NO (SINo)

Feature　　SINo　Details

182. Schena et al. (1991) Proc Nat'l Acad Sci USA 88: 10421
183. Schenborn and Groskreutz (1999) Mol Biotechnol 13(1): 29-44
184. Schlaman and Hooykaas (1997) Plant J 11: 1377-1385
185. Schoffl et al. (1989) Molecular & General Genetics 217(2-3): 246-53
186. Sengupta-Gopalan et al. (1985) Proc. Nat'l Acad. Sci. USA 82: 3320-3324 (1985)
187. Shah et al. (1986) Science 233: 478
188. Shaw et al. (1984) Nucleic Acids Res., 12: 6031-6041
189. Sheehy et al. (1988) Proc Natl Acad Sci USA 85: 8805-8809
190. Sheen et al. (1995) Plant J 8(5): 777-784;
191. Sheridan et al. (1996) Genetics 142: 1009-1020
192. Shewmaker et al. (1985) Virology 140: 281-288
193. Shirsat et al. (1989) Mol Gen Genet 215(2): 326-331
194. Silhavy et al. (1984) Experiments with Gene Fusions, Cold Spring Harbor Laboratory, Cold Spring Harbor (NY)
195. Simpson et al. (1985) EMBO J 4: 2723-2729
196. Simpson et al. (1986) Plant Molecular Biology 6: 403-415
197. Sjodahl et al. (1995) Planta 197: 264-271
198. Slightom (1986) J Biol Chem 261: 108-121
199. Smith and Hood (1995)Crop Sci. 35(2): 301-309
200. Smith and Townsend (1907) Science 25: 671-673
201. Stalberg et al. (1996) Planta 199: 515-519
202. Stockhaus et al. (1989) EMBO J 8(9): 2445-2451
203. Stougaard (1993) Plant J 3: 755-761
204. Sun and Callis (1997) Plant J 11(5): 1017-1027
205. Sundaresan et al. (1995) Gene Develop 9: 1797-1810
206. Suzuki (2001) Gene. Jan 24; 263(1-2): 49-58
207. Svab et al.(1990) Plant Mol. Biol. 14: 197
208. Taylor et al. (1985) Mol Gen Genet 201: 554-557
209. Tepfer (1984) Cell 37: 959-967
210. Tepfer (1953) The biology of generic transformation of higher plants by *Agrobacterium rhizogenes*. In: Puhler (ed) Molecular Genetics of the Bacteria-Plant Interaction, pp.248-258
211. The Maize Handbook, Chapter 116, Freeling and Walbot, Eds., Springer, New York (1994)
212. Tian et al. (1997) Plant Cell Rep 16: 267-271;
213. Tighe et al. (2000) Int J. Syst. Evol. Microbiol. 50: 787-801.
214. Timko et al. (1985) Nature 318: 579-582
215. Trick et al. (1997) Plant Tiss Cult Biotech 3: 90
216. Twell et al. (1983) Sex. Plant Reprod. 6: 217-224
217. Twell et al. (1989b) Mol Gen Genet 217: 240-245
218. Urao et al. (1996) Plant Mol Biol 32: 571-576
219. U.S. Pat. No. 4,801,340
220. U.S. Pat. No. 4,962,028
221. U.S. Pat. No. 4,975,374
222. U.S. Pat. No. 4,940,838
223. U.S. Pat. No. 5,106,739
224. U.S. Pat. No. 5,187,267
225. U.S. Pat. No. 5,225,341
226. U.S. Pat. No. 5,352,605
227. U.S. Pat. No. 5,416,011
228. U.S. Pat. No. 5,463,175
229. U.S. Pat. No. 5,504,200
230. U.S. Pat. No. 5,565,350
231. U.S. Pat. No. 5,608,152
232. U.S. Pat. No. 5,633,435
233. U.S. Pat. No. 5,683,439
234. Van Laerebeke et al. (1974) Nature 252, 169-170
235. van Wordragen et al. (1992) Plant Mol. Biol. Rep. 10: 12-36
236. Vanden Elzen et al. (1985) Plant Mol Biol. 5: 299
237. Vasil et al.(1984) Cell Culture and Somatic Cell Genetics of Plants, Vol I, II, and III, Laboratory Procedures and Their Applications, Academic Press
238. Velten et al. (1984) EMBO J. 3(12): 2723-2730
239. Vernade et al. (1988) J. Bacteriol. 170: 5822-5829
240. Vilaine et al. (Mol Gen Genet (1987) 206: 17-23))
241. Vinuesa et al. (1998) Appl. Envir. Microbiol. 64: 2096-2104
242. Wader et al. (1987) in TOMATO TECHNOLOGY 189-198 (Alan R. Liss, Inc.)
243. Wang et al. (1984) Cell 38: 455-462,
244. Wang et al. (1987) Mol. Gen. Genet. 210: 338-346
245. Ward et al. (1993) Plant Mol Biol 22: 361-366
246. Waterhouse et al. (1998) Proc Natl Acad Sci USA 95: 13959-64
247. Watson et al. (1985) EMBO J 4(2): 277-284
248. Weissbach and Weissbach (1989) Methods for Plant Molecular Biology, Academic Press
249. White and Nester. (1980) J Bacteriol. 144(2): 710-20
250. White (1982) Proc Natl Acad Sci USA 79: 3193-3197
251. White (1983) Nature 301: 348-350
252. White (1985) J Bacteriol 164: 33-44
253. White et al. (1980) J. Bacteriol. 141: 1134-1141
254. Willmitzer (1982) Mol Gen Genet 186: 16-22
255. Wilmink et al. (1992) Plant Cell Rep 11: 76-80
256. Wilmink et al. (1992) Plant Cell Rep. 11: 76-80

TABLE 4-continued pRi2659 Δ open reading frames and their protein SEQ ID NO (SINo)

| Feature | SINo | Details |
|---|---|---|

257. Wirawan IGP and M Kojima (1996) Biosci. Biotechnol. Biochem. 60: 50-53
258. WO 00/15815
259. WO 00/26388
260. WO 00/44895;
261. WO 00/44914
262. WO 00/49035;
263. WO 00/58484
264. WO 00/63364
265. WO 00/68374;
266. WO 02/00900
267. WO 03/060133
268. WO 03/08596
269. WO 84/02913
270. WO 91/13980
271. WO 91/13991
272. WO 92/16635
273. WO 93/01294
274. WO 93/07278
275. WO 93/21334
276. WO 93/21334
277. WO 94/02620
278. WO 94/21794
279. WO 95/15389
280. WO 95/19443
281. WO 95/23230
282. WO 96/12814
283. WO 97/41228;
284. WO 98/18940
285. WO 98/22593
286. WO 98/45456
287. WO 98/45461
288. WO 99/16890
289. WO 99/32619
290. WO 99/53050;
291. WO 00/26388
292. WO 84/02913
293. WO 92/16635
294. WO 95/15389
295. Yadav et al. (1982) Proc. Natl. Acad. Sci. USA 79: 6322-6326
296. Yeo et al.(2000) Mol Cells 10(3): 263-8
297. Young et al. (2001) Int J. Sys. Evol. Microbiol. 51: 89-103.
298. Young et al. (2003) Int. J. Systematic & Evolutionary Microbiology 51: 89-103.
299. Zambryski (1992) Ann. Rev. Plant Physiol. Plant. Mol. Biol. 43: 465-490,
300. Zambryski et al. (1983) EMBO J. 2(12): 2143-2150,
301. Zupan and Zambryski (1995) Plant Physiol. 107: 1041-1047
302. Zupan et al. (2000) Plant J 23(1): 11-28

SEQUENCE LISTING (188 sequences)

SEQ ID NO: 1 - DNA, 2880 bp, Agrobacterium strain K599 (NCPPB 2659)
  misc_feature (814)..(2880): right T-DNA flanking region from Agrobacterium strain K599 plasmid pRi2659 used in deletion constructs.
gcatgccgttcacgaagtcgaggttcgtgaagtattggttgtttgtcccgaccgcgaaggtgccggtccggatatcatgaagctccttcggctcgatatggaggattgcctttgttgaaagcgtgatctctgcaacgagctgtcggaggtcgggagcgacttgcctgcaggccatgtgttatgaacaagaaggtggaagcaaatagatgatgttaggaaagggtgggattgcagggtgggcaggcacgatacttatagtggaaaaaggtatggagcaatttcgccgaaatctgggtgggccttctaaatattgggcgggccgcccacgtaactataattgcaggggcccaccaggttaattgcgtggccgcgttgattgggtgatattattacctaacatgagattgttatttgacaggatatatccccttgtctagttcgtcagttcgtcagttcgtcagttcgtcagttcgtcagttcgtcagttcgtcagttcgtcagttcgtcagttcgtcagttcgtcagttcgtcagttcgtcagttcgtcagttcgtcagttcgtcagttcgtcagttcattaacattgctccgcgcttgcctgatttgagaggttgtctctgcacgggtctgcagcgacatatggctacgaggacctaccttgccgatgagccgtatccatccggcgtaggccgcggggtttatgatctcggctcgtctgccatgatgcgttcgatcctttcgggatcacattgctcatcgacgcggaattgccggacaccgcccctcgcaggtgcggataccggcgaggaattcctttaagctctcgatgccccggtcggtgaaggtcgtgacgccctcttggctgccgtcatgggcatggatcatctcgccgtaatcgatattgtctgagttgctggcgatttcctggaggagttcgaggttctcgccgatcagcgaagcaacataatcgatcgtgtagacatgcgtcgggcgcgctgaccttgccccgttgtgagccgctaagcgcattgtcctcaccaccagctcatgtgctgtaacgcgcgaagctgtcgcaggctgtaccctctataagttaaggtacaactctgccgttggatgaattagcctcctgaaacgcttcctttacgtggctgatcaaagcacgttcagtctcgttaagcggcgtggaggtggagaatattgcccatagtcgccgcggcgggactaaatggtcgagagagaacgtgtccacgatccctgcctcgatctccttgatcatcaccgacgctggcaagatcgtgccaagaggtgaacgacgcaaaaccgagacgatcagaggtaccgaacccaaccgcattaccggctcgagctgcacagtagacttcgcaagtgccgtcagaagagtttgatgcattgtgagctgtgaaggtgccagaaggagcgggatgctcctcagctcgtctgccgaaactctctcggcctgaggcgcaaaattcagcttcctattgacgatcaggacgacgtcttcgctgcggccaattagtagagagcctacttgcggatcgatcctaccaacgacagcaatattgaaacggccggttagaacgccatgatgcagtacatgtcgagggccctccacaacctcgatttggcagttcggaaaattcattgtgaaatgcgctaagcgccacggccatgcattcggacgtcaaggaatctgcgctccaactcaccggtaacgcaatccgaattgattgttcaaaggccgcagctatgtggcttcgttcgcccagagtgtcgttgaaagccctctcaacgccgacaaacagcgaatgcagcctttcagcatcatcggtcggttcagaaccggtcttcttccggtcgataagccttgtcccgagcgcatattcgatctgttcaagctgggccggtatcatcggagcagtccgtccggcgacgcgggcagcgctcgccatgctgccggtctgcaccacacgattcacggtagaaatctgcttcaggctaaccttgggatggaaattcgtggcttcggaccagcccgaaggggcctcgacgcctttgcggacatcatttagcagatttaacagaagttcatggtcgttagagagctctgcggtcacgcagcacgacggactgcgaattaccggaaccgcagtgatgccctggatgcgaagacgctggggtacagtcagttggggcagaagtagatccgacttgcggatgtcgtcgatgagccctcggagatcctgcagacttcgatcggtggtggaaatccgtgatgtcgcgataccgctggagcggtcgaatttcgtgtcgctttgcagtgtacccggcagatcgggaatttcggtttttggagcaatgtcaccacgctcgggtcgctccccaaccgtatgggtcagcctcgtccaatggtctggagcaacgacaacagaaggtccggataccccagtaccgatggtatgttggatcttgagctgcccgagtggcaccgcgtctgacagaagatggctgggaccgttctgcattccgaaggcgccagtacccgtgaagatcaagtctacataagggtggtcgggtttggaatggaagcggcggatcgccgtgattacagcgtaggaaattgctgtccaggtatagtcaacgtctaatttgaggatgacgggcgccgaaggcgccgcgctgccgccaagtttggcatgactcaaatattcctcggcaaggaggagacgaacactgcgattgtacagccagaccgccgagcgtagcggaaaggagttacgccctttgcgaccaaaaagcgtcactccaatctgggcttcgagcgtgctgagcttggcatctcaatgccgatggtgt

SEQ ID NO: 2 - DNA, 7498 bp, Agrobacterium strain K599 (NCPPB 2659)
  misc_feature (5347)..(7492): left T-DNA flanking region from Agrobacterium strain k599 plasmid pRi2659 used in deletion constructs.
gcatgctttgttaatgtaaatctggatgtaatatatataaattgaaactatttgccggaattatctttttattctgatgtacacgtaaatggcgacatgtcattgaaattcaataaagctgtctccctagacaacatcaacaattaaagagatgaacgaaaattcaaaaaagtcggaaaattacggcccaaatttatgcaatttcgaacatgcaataagattgacaaaaggaattcaacatacaatggcaacacaaatatcaaacacattggaaacttccgttactgcttctgttttgtatcgtgctcataatgtcctatcaattaagccaaatacatctttaacgctcgcaatttcattatcatcgcttccatcgtcttccaggaattcggcataactttcgagcattttagcagcagcatcgaggatcagaacaccaatttcattgaactccttacagggatgtggttcccggaaagttatatattggctgcagaagctcgctctgctgatatcgcggggctcaaccattgtcggggcgtcgaaaagaccgagaacgtattttctgacaacctgggggtcgacgagttcaaactgactttcattttcgagggagaaggcggtgagtggaagtccgtcttctttggcggcgtagcaacggctggcatggtcgcagaagagacaaaaaacatcactcagcgggacggaacaaagatcagtccgtttgaaaaaggtggcgagtgcagcagcggaaagattaagacaagatgaagggcctgtgtgaagaccgaaactcggtgccccaaccagccctatatacctgctccccaaggacgggtggaagcacctccaacgcgcggtgtgactcgacatccacttccagacacagaaccttgtcacactgataaactaccgtcccaggtttattggcggcaattccgaagaccgtactgccaagcaattctctatcccgctcgaccaagccgagatgggtgaaatcggcggcggcaagtttactgttgtcggggaccggagcgaaaagaagttcaaatttggacctgggcggacgtggacttggtctgcgaataccgtgctgcttccaatgacttttcaatttctctgcagtcactgtgccatcgcctttcataaaattgtaactctctatcattctggcttcgacgagagctccagaactcgcaaactggagggtgaaatggacagaaaccggagagttgctggaactcatcctcggctgaatgaagatgtatacgatggcaccttctccaatatcctgagcaacttctttctcgatcttttcacggacagcatggctgatcccgctcggaagtggctaacatagcacttgctatgtcggggtggcagattgcgcactggtaccctattccgaggtctcgcactggagtttcaccggcggcgacggcaattcggtgatttagagcaggcatccgccgaatgacgtcgccgaggcctgtcactttttcggcatccattgcagcaacgacattacatatgccgctaagaccctctgggcgacagcggccgtaatcacatctacaggatcatgcaaaatctgcagcgcagcgagttctctcttccagttaccctccgggaaggcgaccgcggcagcgcacatcgcgtcgctggctggcatggtagcaaggccaaaaaaggcaagaccttggaaagggagaggtggatgattggcggtgtttataggaagtcaacgggtctgcaggtctacatcgacataatccggccttgcacgcaaacattgtcagcctggccccacattgataatggctggccaactaatccctgctaagagttatttctctcaccaaaaagtcaactaatgcttgccgcgctgcgttacatttaaggcttcattcagatcgtatttacaccagctttgaatatgtctcttgttgaggtcattccggatatcgcggaacgggtagcacgcggtcttacggatccctctctccgggttctgctcgccttcgatggtgatggcaccgcctttaagcaagatcgaaaccgtcagtgctgggaaaattaatcctgccatcgatatcatcgacaatttgaccaagatcgcccggaagggacattacctactgctgacgtccgctcgccactgcggcgaaatcgctgcttcgcccttcaaagacattccaggtattgattttcaagggaatgacggaacggtcacaatcttcaaaggtcaacgttttgaatccgttcccctgcccaactggagccgcattcatgcggttatggagagcgaatttggcggcaacccagaaatccgcaacattccgatggagcatttctatggctgtcagatgtgggactctcatccacgttaccaatcggccggagatctgctttcatcgcttcttccgcgtgtagatcattcctggggacgcactttccgggcgaccgcagtacccgagggtcattgcgttatgcccgaggaaacgccaggcaagcgcaaaggctattttgcttatgtcaatctactccctcgtgagatcggcctacatatagcgtgcggcaacggcgaaaacgataaagatatgctgaccgctgttggcaacaaggagaatggtatcgcgttctgggtcggtacccgtgagacgaagcccactggaaccaacgtcttcgccataccgaatgaggatgctctctctgcaattcttggcgatctcggcgtgttgttgcccgatctgagcaagtgatcgctccgatctgccgctgttctattacatccatagtcaccgtaggaagggaaagaagtcataattgcttcagttgttacttagttttttctatttttagtgtctatgatccgccactccggcgactatttcaatacacaacgccagaaataatataatatctccatgagccactgcattattgaataaataactatggaatctttttcaccgaaaattatttatattttatatactttatttaattaatcaataattcagaatagaatatttttaatataaattctttcaacatcattaagtacttaagactcccgccggataaggattaattattacaagaatcctttttagaaaagctcatatttatctggcagccttccgaaaccgatggaaaacgatatcctttgccagcgcaaaccgttccccgtgaaaggcacatgttggcccgagtggaagctcgaatgggatctcccaaatggtgtcacggcggatgaggtctcgcccggcactcggtaccgaacctccttgaacgtcttgaagagactctgcctcttcaagtcatcgaacacagaggcatgtacaatctcggaaagcgagtacaggaatgcactgaaacgtcgttgctcgctgctctcggagagataggcaggcgcaatctttccgagctcgatgccgcactcagctctgacgatgtgcccatcgcctctcacgacttcaacttgtggcgagtctccgctttgcccgaccaactcgtacggcatagtcgacagaatgtatttgttctttttataaaatgttagtagtgaatattattggcgccctttctaattgctccaatctgcttgtatttcctatttatataatttggaaaataagtgcaggctcacgtattgttgcacgacgacgattggcgataaaattttcacctttattatttaaaggcgcggatattattattattttaatatcttaaataaaaattgtaattagataggctgtattaatcacttttaaacatacccggacaccatctggtaatatagcaaaaacgtgctcaaaaatcgcttcaaagctcttgtacttagctcgtttacaccacaatatatcctgccaccccacataaggcgacatcgtgctttgccttgggtcgcttatgaggtgcgccatgatcaagagcgatgatagccgcaacctattcgcgaccttttcatgagggagcacgtttcggtaatatcttgaagcaaggcccgttgtaaggcggttttgttcgtttggagacctcgggcggttggcaggaaagttctgatgacagtgtgcgccacttcgcttattgaactcggctgtataaaatcaggcattgggccaagacactgcgctggagacggatatcatcgtcgtttgcgcaaccgctgacggcttgcacgtcggtcaacttcttccggtcacgacgctccaccgcccttaagaggcggtccataaagttgagcgcaacaaatcgccgattggcgacgctataaatgctggaggcccctaagggatgtcgaggcgcctgcatccggaggaaaacctctcggcacgacgacggcgggcggactctgtccacgtagcgtgccaatgcttccgcaacggagggcatccagcggatagatcctggggcttgtcggcgctttaagcggaaaagccgaagcgttcgccccgcccagtcgatttggtcgagccgcagcgcggctacttcgccgcgccgcataccatataccgccagcaacattaggatcgcgcggtctcggatatcgcggggccggtcggtatcgacatcagccaacatcttttggacgtccgaccagtctggggcatatggcagagattcttgtcgatagagccgaggccgcgatattgacgacaccaggcggtctgagcaccaagcctcttttgccgcatatcgaagaaatccgcgcaaggctgagacgatgtatgcaatcgagacacgaccccagcgtccggccccttgggtcgctatatagttgtcgatgtcttctgccttcaaatccttgagccggtggctcgactgttcgcaccacagcaagaatctgccggctatgcgcccccattgttccaccgtcgacggatgtcaatccgcgttcgtcgcgcatccagccaacataccggtcgagttgcgcctggtacgacaatatgacagtgggctcacgccaccagccaaggaacttcagccaggggcgcccgatatcgacgacccgacgtgcagcggtagccgcaccgtgaacattctgccgagcctgcgcgatcggcaacaactccgccatgccgacgccggccgcagcctctggaccgagatgtcgcgcgatccacaggagttcgttgcgtttgaccctgagaacttcgggtctcgctccgagtgtggcgcagtgatgcaaatagcggttccgctcgtcagcaaatggcacttcggtaaatagggcatcagcggcttggtcggaaaaggaagggtgatccatgtcgaacctccaaacgagaaaaggtccggctgccaaacttgcgatttatgttgcgtcaaatcgggcccaaatactcagttgacaaagggtataggtcagcagggccacatatggacggccgcaacatagcccccgatatgttcggcagaacatattggcggctacaatccgctgttcaaggtagacccgcgatccggggccgctgacgcaggcgctctgctggtcgcacgcgaggcgcaagttcttcgtgctggccgacatcgccacgaatgccaaacgcggcagccgcgccgcaccgatctcgcctatggcgttggaggccgtcaaacggatcgatgccctgttcgacatcgagcggcagatcaacgggcttgccgcagcggaacgcctggagcgccgtcgcaaggacagcctgccgcttgtcggcgaactgcactgctggcttcaaaccgaacgggcaaaactgtcgcgcagttctccagtcgccgagccgatcgactacatgctgaagcgctggaacggcttcacgtctttcctcgacgagggcaggatttgtctcacgaacaacgcggccgaacgagcgctgagaggctttgctctcgggaggaagtcatggctcttcgccggatcggatcgaggtgccgatcgcgccgccttcatggcgacactgatcatgacagcattatgccgcgcgcggcataaggcggtttatgccgaccggcgaactatgccgagcacctcttccaacttaccagttgaaacgcgcttctcttgccgttttggtcgaagacccgtcgttggcactcggcatagttctcatgctcagagggcgttcaggaattccagaagccggtcgtttggtcgaaatcgctcggccttggcgcgttcgtacggcttcagctttgcgagtgtcgattccttcagttcaagatgtgcatgaagataggtcagcgtcgtttccatcgcctcatggcccagccacagggcaatgaccgagcagtcgacgcccgcctgtagtagctccatggcagcgctgtgccgcaagacgtggggcgacacccgcttcgagcggagggagacgcagtgctcgcgcgctttggcgacatatttgttcagcagtgcctgcacgccgtcggcgctgagcctgccaccgtgcatattcggaaagagagccgttgcgcctcgcttccctggttccttgagccaacgccggagggcttcctgtgcaacctttgtgagcggcgtacttcgctctttgcggcccttaccgacgcattgcacatgcgcaccgcggccgagcattaccgagtctcggtcgaggtcgatgacttccgaaacccgcagccccgtttgcgcggccagcaatagcagagtgtaatcgcggcgtcccagccacgtgcttcgatccgtgcagtccaggatcgattcaatctcgggcctggttaggaactgaagctgccgcttgtcgcatcgcttgctggggatcgcgagcacgcgctggatgtgggcgctatgtgccggctcctcgaacgccgcatatcggaagaaagatcgaatggctgtgaggcggagattccgggtcctcaccgaggcggctctctgcgtctcgaggacttccaggaatgcgccgatgaacggagcgtccaaatcccgcagtgtcaattgagatggggacctcccaaggcgcgcctgcgcgaacgcaaacaggagcctgaacgtgtctcgataggaggcaatggtgttggaacttacacctcgatgcttcatgagccgatctgtgaaccaccgctcgatcagcacggctaagtcgttcgttcgtctcatgaccgaacctcccaccgcttatccaatcgccgaacggcatgattcatcagctccggcgcggcggacagataccagtaggtgtcgcgaacattggcatggccgaggaaggtcgagagtaccggcagctcgcgttccacatcttcgccagcgcgatgccagttgatcagggtttggacggcgaaacggtgacgaagatcgtgaacccgcgggccaccgcgatccccctcctgccgtaaaccaatttgccgggatagtcgccagaacacccggtgcacgtattgatgcagcaatctgccgccctgttcggcgacgaagaaatagggactgcgcggcgtgccaaggtgtgcatcgcgtcgggcagcatagtttgtaaggacagcgattgtcgtggcatgc

SEQ ID NO: 3 - DNA, 5941 bp, Artificial
  Nucleic acid sequence of cloning vector pRL278 (GenBank Acc.-No.: L05083)
  misc_feature (473)..(1894): CDS for sacB from B. subtilis, complement
  misc_feature (2749)..(3543): kanamycin and neomycin resistance CDS nptII
  rep_origin (4816)..(5941): pMB1 replication origin including oriV and oriT
gctggctgttttacgcgtatgacaggctccggaagacggttgttgcgcacgtattcggtgaacgcactatggcgacgctggggcgtcttatgagcctgctgtcaccctttgacgtggtgatatggatgacggatggctggccgctgtatgaatcccgcctgaagggaaagctgcacgtaatcagcaagcgatatacgcagcgaattgagcggcataacctgaatctgaggcagcacctggcacggctgggacggaagtcgctgtcgttctcaaaatcggtggagctgcatgacaaagtcatcgggcattatctgaacataaaacactatcaataagttggagtcattaccaaaaggttaggaatacggttagccatttgcctgcttttatatagttcatatgggattcacctttatgttgataagaaataaaagaaaatgccaataggatatcggcattttcttttgcgtttttatttgttaactgttaattgtccttgttcaaggatgctgtctttgacaacagatgttttcttgcctttgatgttcagcaggaagcttggcgcaaacgttgattgtttgtctgcgtagaatcctctgtttgtcatatagcttgtaatcacgacattgtttcctttcgcttgaggtacagcgaagtgtgagtaagtaaaggttacatcgttaggatcaagatccatttttaacacaaggccagttttgttcagcggcttgtatgggccagttaaagaattagaaacataaccaagcatgtaaatatcgttagacgtaatgccgtcaatcgtcatttttgatccgcgggagtcagtgaacaggtaccatttgccgttcattttaaagacgttcgcgcgttcaatttcatctgttactgtgttagatgcaatcagcggtttcatcacttttttcagtgtgtaatcatcgtttagctcaatcataccgagagcgccgtttgctaactcagccgtgcgttttttatcgctttgcagaagtttttgactttcttgacggaagaatgatgtgcttttgccatagtatgctttgttaaataaagattcttcgccttggtagccatcttcagttccagtgtttgcttcaaatactaagtatttgtggcctttatcttctacgtagtgaggatctctcagcgtatggttgtcgcctgagctgtagttgccttcatcgatgaactgctgtacattttgatacgtttttccgtcaccgtcaaagattgatttataatcctctacaccgttgatgttcaaagagctgtctgatgctgatacgttaacttgtgcagttgtcagtgtttgtttgccgtaatgtttaccggagaaatcagtgtagaataaacggatttttccgtcagatgtaaatgtggctgaacctgaccattcttgtgtttggtcttttaggatagaatcatttgcatcgaatttgtcgctgtctttaaagacgcggccagcgtttttccagctgtcaatagaagtttcgccgactttttgatagaacatgtaaatcgatgtgtcatccgcatttttaggatctccggctaatgcaaagacgatgtggtagccgtgatagtttgcgacagtgccgtcagcgttttgtaatggccagctgtcccaaacctccaggccttttgcagaagagatatttttaattgtggacgaatcgaattcaggaacttgatatttttcatttttttgctgttcagggatttgcagcatatcatggcgtgtaatatgggaaatgccgtatgtttccttatatggcttttggttcgtttctttcgcaaacgcttgagttgcgcctcctgccagcagtgcggtagtaaaggttaatactgttgcttgttttgcaaactttttgatgttcatcgttcatgtctccttttttatgtactgtgttagcggtctgcttcttccagccctcctgtttgaagatggcaagttagttacgcacaataaaaaaagacctaaaatatgtaaggggtgacgccaaagtatacactttgccctttacacattttaggtcttgcctgctttatcagtaacaaacccgcgcgatttacttttcgacctcattctattagactctcgtttggattgcaactggtctattttcctcttttgtttgatagaaaatcataaaaggatttgcagactacgggcctaaagaactaaaaaatctatctgtttcttttcattctctgtattttttatagtttctgttgcatgggcataaagttgcctttttaatcacaattcagaaaatatcataatatctcatttcactaaataatagtgaacggcaggtatatgtgatgggttaaaaaggatcgatcctctagctagagtcgacctgcatcccttaacttacttattaaataatttatagctattgaaaagagataagaattgttcaaagctaatattgtttaaatcgtcaattcctgcatgttttaaggaattgttaaattgattttttgtaaatattttcttgtattctttgttaacccatttcataacgaaataattatacttttgtttatctttgtgtgatattcttgatttttttctacttaatctgataagtgagctattcactttaggtttaggatgaaaactagaggatctcaatgaatattggttgacacgggcgtataagacatgttatactgttgaataacaaggacggatctgatcaagagacaggatgaggatcgtttcgcatgattgaacaagatggattgcacgcaggttctccggccgcttgggtggagaggctattcggctatgactgggcacaacagacaatcggctgctctgatgccgccgtgttccggctgtcagcgcaggggcgcccggttctttttgtcaagaccgacctgtccggtgccctgaatgaactgcaggacgaggcagcgcggctatcgtggctggccacgacgggcgttccttgcgcagctgtgctcgacgttgtcactgaagcgggaagggactggctgctattgggcgaagtgccggggcaggatctcctgtcatctcaccttgctcctgccgagaaagtatccatcatggctgatgcaatgcggcggctgcatacgcttgatccggctacctgcccattcgaccaccaagcgaaacatcgcatcgagcgagcacgtactcggatggaagccggtcttgtcgatcaggatgatctggacgaagagcatcaggggctcgcgccagccgaactgttcgccaggctcaaggcgcgcatgcccgacggcgaggatctcgtcgtgacccatggcgatgcctgcttgccgaatatcatggtggaaaatggccgcttttctggattcatcgactgtggccggctgggtgtggcggaccgctatcaggacatagcgttggctacccgtgatattgctgaagagcttggcggcgaatgggctgaccgcttcctcgtgctttacggtatcgccgctcccgattcgcagcgcatcgccttctatcgccttcttgacgagttcttctgagcgggactctggggttcgaaatgaccgaccaagcgacgcccaacctgccatcacgagatttcgattccaccgccgccttctatgaaaggttgggcttcggaatcgttttccgggacgccggctggatgatcctccagcgcggggatctcatgctggagttcttcgcccaccggggatcctctagactgcgatgagtggcagggcggggcgtaatttttttaaggcagttattggtgcccttaaacgcctggtgctacgcctgaataagtgataataagcggatgaatggcagaaattcgatatctagatctcgagctggatacttcccgtccgccagggggacatgccggcgatgctgaaggtcgcgcgcattcccgatgaagaggccggttaccgcctgtttgaggatatagtaatctttctaaatagctttggattggaggagtatggccactaatactaagttcagctaataaaaaaatttgctaaagaactccagctggatttcactgatgagaatatcgtcggagataaatataataattccacggactatagactatactagtatactccgtctactgtacgatacacttccgctcaggtccttgtcctttaacgaggattgttacgtacgctaatggcgtcaaaacaaagactctagacctaggccttaagatcgaaagagctggtagttggcgcactgttcgaagaactgccgatgtccagtaagattcttactatgctggttgaaccggatgctggtaaagctacttgggttgctgcttctacttatggtaccgatacaactactggtgaggaagttaaaggagctcgcgaaagcttgcatgcctgcagcaatggcaacaacgttgcgcaaactattaactggcgaactacttactctagcttcccggcaacaattaatagactggatggaggcggataaagttgcaggaccacttctgcgctcggcccttccggctggctggtttattgctgataaatctggagccggtgagcgtgggtctcgcggtatcattgcagcactggggccagatggtaagccctcccgtatcgtagttatctacacgacggggagtcaggcaactatggatgaacgaaatagacagatcgctgagataggtgcctcactgattaagcattggtaactgtcagaccaagtttactcatatatactttagattgatttaaaacttcatttttaatttaaaaggatctaggtgaagatcctttttgataatctcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgtccttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagcattgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgttctttcctgcgttatcccctgattctgtggataaccgtattaccgcctttgagtgagctgataccgctcgccgcagccgaacgaccgagcgcagcgagtcagtgagcgaggaagcggaagagcgcctgatgcggtattttctccttacgcatctgtgcggtatttcacaccgcatatggtgcactctcagtacaatctgctctgatgccgcatagttaagccagtatacactccgctatcgctacgtgactgggtcatggctgcgccccgacacccgccaacacccgctgacgcgccctgacgggcttgtctgctcccggcatccgcttacagacaagctgtgaccgtctccgggagctgcatgtgtcagaggttttcaccgtcatcaccgaaacgcgcgaggcag

SEQ ID NO: 4 - DNA, 16110 bp, Agrobacterium strain K599 (NCPPB 2659)
agatctatccgctggtgccctccgttgcggaagcattggcacgctacgtggacagagtccgcccgccgtcgtcgtgccgagaggttttcctccggatgcaggcgcctcgacatcccttaggggcctccagcatttatagcgtcgccaatcggcgatttgttgcgctcaactttatggaccgcctcttaagggcggtggagcgtcgtgaccggaagaagttgaccgacgtgcaagccgtcagcggttgcgcaaacgacgatgatatccgtctccagcgcagtgtcttggcccaatgcctgattttatacagccgagttcaataagcgaagtggcgcacactgtcatcagaactttcctgccaaccgcccgaggtctccaaacgaacaaaaccgccttacaacgggccttgcttcaagatattaccgaaacgtgctccctcatgaaaaggtcgcgaataggttgcggctatcatcgctcttgatcatggcgcacctcataagcgacccaaggcaaagcacgatgtcgccttatgtggggtggcaggatatattgtggtgtaaacgagctaagtacaagagctttgaagcgatttttgagcacgtttttgctatattaccagatggtgtccgggtatgtttaaaagtgattaatacagcctatctaattacaatttttatttaagatattaaaataataataatatccgcgcctttaaataataaaggtgaaaattttatcgccaatcgtcgtcgtgcaacaatacgtgagcctgcacttattttccaaattatataaataggaaatacaagcagattggagcaattagaaagggcgccaataatattcactactaacattttataaaaagaacaaatacatctgtcgactatgccgtacgagttggtcgggcaaagcggagactcgccacaagttgaagtcgtgagaggcgatgggcacatcgtcagagctgagtgcggcatcgagctcggaaagattgcgcctgcctatctctccgagagcagcgagcaacgacgtttcagtgcattcctgtactcgctttccgagattgtacatgcctctgtgttcgatgacttgaagaggcagagtctcttcaagacgttcaaggaggttcggtaccgagtgccgggcgagacctcatccgccgtgacaccatttgggagatcccattcgagcttccactcgggccaacatgtgcctttcacggggaacggtttgcgctggcaaaggatatcgttttccatcggtttcggaaggctgccagataaatatgagcttttctaaaaaggattcttgtaataattaatccttatccggcgggagtcttaagtacttaatgatgttgaaagaatttatattaaaaatattctattctgaattattgattaattaaataaagtatataaaatataaataattttcggtgaaaaagattccatagttatttattcaataatgcagtggctcatggagatattatattatttctggcgttgtgtattgaaatagtcgccggagtggcggatcatagacactaaaatagaaaaaactaagtaacaactgaagcaattatgacttctttcccttcctacggtgactatggatgtaatagaacagcggcagatcggagcgatcacttgctcagatcgggcaacaacacgccgagatcgccaagaattgcagagagagcatcctcattcggtatggcgaagacgttggttccagtgggcttcgtctcacgggtaccgacccagaacgcgataccattctccttgttgccaacagcggtcagcatatctttatcgttttcgccgttgccgcacgctatatgtaggccgatctcacgagggagtagattgacataagcaaaatagcctttgcgcttgcctggcgtttcctcgggcataacgcaatgaccctcgggtactgcggtcgcccggaaagagcgtccccaggaatgatctacacgcggaagaagcgatgaaagcagatctccggccgattggtaacgtggatgagagtcccacatctgacagccatagaaatgctccatcggaatgttgcggatttctgggttgccgccaaattcgctctccataaccgcatgaatgcggctccagttgggcaggggaacggattcaaaacgttgacctttgaagattgtgaccgttccgtcattcccttgaaaatcaatacctggaatgtctttgaagggcgacgagccgatttcgccgcagtggcgagcggacgtcagcagtaggtaatgtcccttccgggcgatcttggtcaaattgtcgatgatatcgatggcaggagtaatttcccagcactgaggctttcgatcttgcttaaaggcggtgccatcaccatcgaaggcgagcagaacccggagagagggatccgtaagaccgcgtgctacccgttccgcgatatccggaatgacctcaacaagagacatattcaaagctggtgtaaatacgatctgaatgaagccttaaatgtaacgcagcgcggcaagcattagttgactttttggtgagagaaataactcttagcagggattagttggccagccattatcaatgtggggccaggctgacaatgtttgcgtgcaaggccggattatgtcgatgtagacctgcagacccgttgacttcctataaacaccgccaatcatccacctctccctttccaaggtcttgccttttttgccttgctaccatgccagccagcgacgcgatgtgcgctgccgcggtcgccttcccggagggtaactggaagagagaactcgctgcgctgcagattttgcatgatcctgtagatgtgattacggccgctgtcgccagaggtcttagcggcatatgtaatgtcgttgctgcaatggatgccgaaaaagtgacaggcctcggcgacgtcattcggcggatgcctgctctaaatcaccgaattgccgtcgccgccggtgaaactccagtgcgagacctcggaatagggtaccagtgcgcaatctgccaccccgacatagcaagtgctatgttagccacttccgacgggatcagccatgctgtccgtgaaaagatcgagaaagaagttgctcaggatattggagaaggtgccatcgtatacatcttcattcagccgaggatgagttccagcaactctccggtttctgtccatttcaccctccagtttgcgagttctggagctctcgtcgaagccagaatgatagagagttacaattttatgaaaggcgatggcacagtgactgcagagaaattgaaaagtcattggaagcagcacggtattcgcagaccaagtccacgtccgcccaggtccaaatttgaacttcttttcgctccggtccccgacaacagtaaacttgccgccgccgatttcacccatctcggcttggtcgagcgggatagagaattgcttggcagtacggtcttcggaattgccgccaataaacctgggacggtagtttatcagtgtgacaaggttctgtgtctggaagtggatgtcgagtcacaccgcgcgttggaggtgcttcaccgccttggggagcaggtatatagggctggttggggcacgagtttcggtcttcacacaggcccttcatcttgtcttaatctttccgctgctgcactcgccacctttttcaaacggactgatctttgttccgtccctgctgagtgatgttttttgtctcttctgcgaccatgccagccgttcgtacgccgccaaagaagacggacttccactcaccgccttctccctcgaaaatgaaagtcagtttgaactcgtcgacccccaggttgtcagaaaatacgttctcggtcttttcgacgccccgacaatggttgagccccgcgatatcagcagagcgagcttctgcagccaatatataactttccgggaaccacatccctgtaaggagttcaatgaaattggtgttctgatcctcgatgctgctgctaaaatgctcgaaagttatgccgaattcctggaagacgatggaagcgatgataatgaaattgcgagcgttaaagatgtatttggcttaattgataggacattatgagcacgatacaaaacagaagcagtaacggaagtttccaatgtgtttgatatttgtgttgccattgtatgttgaattccttttgtcaatcttattgcatgttcgaaattgcataaatttgggccgtaattttccgacttttttgaattttcgttcatctctttaattgttgatgttgtctagggagacagctttattgaatttcaatgacatgtcgccatttacgtgtacatcagaataaaaagataattccggcaaatagtttcaatttatatatattacatccagatttacattaacaaagcatgccttctataaacaaaaggaaattctatattctctcaatactccatatctacatgatggatcttccctataaccgcccccgtttccccccgtttgctatcaccggtctacctagtgcggccaaactgaaacgagcaatttctcgggcctttgtctgctatgaccagttttgcgatgaactcctacaatatcagcaaaggtggacggattgggtgttcgaccacggatttgcagaagccatagaagacatggctctggtgttccagattgaaccttgccttcatggtccccgaacaggcacactggaagtgctgagatcttgtcgcacgaaggtcttcatttatacgtcgtaccgcaggttgcgccactttgttgagaaccagtgcattgctcaacctggcgacgccgtccttgcttgcatgatcccgccctacgtgagtgacctctcactgcaggaaatgtctcgagcccacaatagtttttgtccaggcagtcacacgagcattgcagacgtgcagtgctttattgccatccaactcagcagcctatttgttgaggagggtacatgtgatgtgcatgggcgaaatggattaaaaacaacctgccgcttctttcgtcgtcccgctgagtgcttcagccgttacgacatagttgcaatagggtctgtgctctttcacaacgcattgcatcagccagcgaactacaatgaggatctttcttgcttcgatctgcggtacgactatcaggttttcctccatgagcgcgatgccaatgatggtgtggggcattatccggaaggcacaccactacctagtgtcgccatcgtaggtggtgggctctctggccttgttgctgctgcagaactacttgacgctggcgtcagggaaatagccctttttaccccagtagatgaggttcggagtttgggtgtatcgccgatgtcaaacggcgacgctcgccaggtcttgacgtcattcggtgtcatgcccatctccggcaaccaagtttgtctgtcatactatctggataagtttagaattccgtccagccttcgttttccttgtgccggcaacgatcacacagcactctacttccggaaaaaacgttacgaatggccggctggacaagctccaccaggtgaattccagcggatatctgcagggtgggagaaactactataccacgggtgtgaacggaacggcaggaggctgatcgctccgatggatatcttttccatgctgagaggtcggcgttatgaagaagcctcggaagcaaggcgggcttggctcagggagtttgataatttcactttccatgccgctctggtcgagatcttcagctgcggtgtcgagagtcctggtggggcggcatggcaaacaactgattttgctgctttcgggatgatgagattgggcggcggccgagtttcttcctgttacaccctactgttttcgacagtcctggactggataatcaatgggtacgaggaggaccagtatatctctgttggaggggttcatcttttgcaggctctgatgcgcattgagatattcaagagaaaagtaggattccattttgaccccctgcgtggactagccaaggagggcgggaaagtgaaggtatgcatgaaagatggccgttcgcgcgtttttgaccaggtcatcattggcgggcgaggtgggcccgatgcaactaatatcactccggttagccatgtgacctgtgtcggctatgatatcgaagcccccgctggaaactcgtctgctactgttaacgcagcacttttcatgatcacaaagcaaaaattctggcttgatgacgatatcccagctttgatctggacggatgggctcgtccgtgagctctgttgtattgacatcgaatcgccatcgggagaggggcttgttatttttcattatgaaatgaacgactatctatcccgcccgttccagtccgatgagaagaagagaaggtgcttggatttagtcagagaacttgctgctgtctttcctgaattggcttgtcatttggttccagtcaacgaagattacgaagaatatgtcttcgacggccacttgaaggatggtttcagggcctctttatggagggaaaattctcttaaaaaatgtcagtacagccaagatccgcatatgtatgattctccgttaatggagcatggggcagtttgccagattgacagtaaggactgcgtaaacggagctttgttcgaagagcaggttaagacgggcatcataacggcctgcaccgtcattcgcagcaccggcgggacactatcttcactccatcccctggattggaataaaatatattttcctgcttaagtatattaatgtattagtgcgtattaatcccgtaagcctgtaagctgcagtagcggcgctcaacttagctttccatgaataataatgtttttcctttatttttgattgaatcctgcttaaaaaatattctttgagtgggcttaaaatgacattaatcagattccaaaaatttccatctgtgaccattagcgccttgatcgatgacattaaagtcttcacatctccagagaaagccttcgtgattgcttgtctccacgtgctttcgcatcttgacagctaatagcgggccccttgacacactagccggccacgcaattcgagatattcccactaaccccaatgaggtcactgcattcgtcattggcagccgccccacttgcattcgccactgtgccgtttggggtccactagccgctaattaggactgcatatattttggacgagctaaggggtcactatcaccttcggtttgaatttccttttcacaagactttaatgttgccaattgagcaggctgaaagaaaatccgcaatcaacggagaaaggttaacagccaaacaaaaaaagaatgcttcatcattgcatagggtctacaacgaccattactttcggcggtgggccttctactatttttttcttagtcttcggccagccatttgttaacttcctatatagatcgcttcaccagaagaatgaattatttagatcatgctgtaatgcttcaatgctgtaagttctaaatgtttgtttcgttttgcaagaaatctattttgctaacagcacttcttttattctcaggatggaactagccggaataaacgttgtcggaatggcccagacctttggagaggcctcgctcgttgtctccgacctatttcggcgggctaaggtcaagaagaagaaggccaaacgtgtgtcgccgggcgatttcctccctgaccaaattgcagagcttgatgatctgagcgtcactcctctggctataacttctcctgggcctcccgtgatggtcaatgatcacggaattgccacgaggggacgctttgtcgctggaccggaatattcagacctacggggttaatacgcagttctaaacaaacctacgggaattaatacgcacgtggctctataatttcgattcatctcgccgccggagatgatgtcggctattttctcgttggtacaataagttgcgagccaccgtgcgattgtttttaattttctatatagtactttaacgtctctctatggcgatttgtaatgtttggaatattattgtctgttaaggcgcctttgtaacaatatcaatgtaaaagcattatcagtattgtgtgagatctctataaatatcgaaatgatttgcctattttctgaaaattggcggcagaaataatgctgtaataatttatttcaacacaagtaaaatacatcgtggcgtacgctacacaactcctaacaggagcatagggctacgccggaaaacatagaaatcctaccaaacttatagttaaaggtggcctgcaggggacctcaagtcgccgaggtttctttcttcagatttactatagcaggcttcatatcaccctcttcacgtttctggttgggtcccgagagccgcagggtgaggtctggctccggtgacggtaccgccggtcgtggcatcacgccagcatttttggtgaactgtgtgatgccgcaagcaatgacgtcataggagcggtttccagtgccttgccgcacgaagaaggtgcaggctacctccctgccgtacacatttgtcacttttaactccagcaggtgaatgaacaaggtacttgcaaaaatggcgataaaaccttccagatcaggttcttccacgcggcggtgcggccaagcaatgttgtgagcacggaccatctcctggagggcgaggtcgctacgatagggttgcatcgtggtcgccagcacggcctctaatccaaacgtgatggatttttcctccagtactttctgcatcttctcgcgagatagatagacaaatacatgtcggtcgttttctctggccaaatccggttgatcgacaagcatggggggatgataacatactttgttttttagaacgatgggccagttgtttaagtatgaccaccggcgacggttttcctccaaatcaagcacgccttgggcccaccttttctggaaatccatgagagttttgctatagacttggctatagattaaaaatgcaaattggatctcattgaacaagttaagctggttccaggcttttgtgagatctcgtggttgaaagcgttgaaggaatagtaatcgaggaggcattgtgatgtgaggttggggataactgtggaataacggcaagttcagtgccatttaaagtacgccgccggcaagtggcatcaatcagccacagtttccggtcgggaaagccagaggcaatctggcaataatcaccatcgcatcaaaatcgatgctcggacatggcggccttaaaacctggatcaagcgaaaaataatgcctgcttgattggtcacgaggtcatagtagtgggctagcatttttgtcttttttgtttggctttagtgaaagtgtatctaaaagatacctgaaatggggaggggtggggtagagcttaaagtttgccgaatattggctttcgtgaaagctgcacgggcaacttgttgatggttgcactctcgatgctatttataattaagatgtaattattgccgctacgtgtagttattgccgataatatcataaattctattgatgtatgtggtatattttgaaattgcatatgtctgctcatacaaataatttatttcaattacgcaattactcttatgccaataaaatgtggattatatagcaagtgtaatcttaaatacaatttggacctatacgacttaatattgccacgccaggcaaccagtccattcggatcttgctataagtgccatactgatacaagttttagatttgaagcccatcaatcgttttagagcccaaaaatcaaaatgggccgaaatagcatttatctaaaagaaggaatcgtggctagttaagtgctttgaatgagatcccatggaaaagcgacacctgtgtggtgcagacaggcctaacgtggtgcacaggttgaaaaagtagtgccttttcgcagcataaataaaggtaggcgcgtgcgaccataattaaaggaaaaagaaagatgctattgacgatgtgacaccattattggacagcagaacctattcccactcgtgcttttgcaaagatgcaaaacccttaaaggccattttaagtacagacacgtgccggtctataattattttacaaatgtgagacgtggaacatcgatagtcgtataatttatgaatattgggttttgcagctatacctaactgatattcaactcatataagcaaaagcatctataaagggaatggtgcttccagttctgggtgcacgccactattgtttcctactttgctaacatggcggaatttgacctatgtgctctcttttccagtcttaaggtaggcgacgtatcgtccagcgatgagctaaagaaacacatccagagcgcctcaaaggagcggacccccctgacggagccgggtgagggccagtcgatggatgttgacgaagagggcggtcgccaagaccctgggatactgtacctctacgtcgattgcccgacgatgatgcgatgcttttatggagggtctttgccctacaattccacgcacggcgcgctcatcaccaatcttccaccataccagaaagatgtaagtctcggtgaggtgtgcagggggcttaggcaggcatcaggattctttggatacgaggatgttatccggagcgcctacttcgccgcactttctgtccccgggtacttcgtcaagctggatgggcagatggaactaacttcaacaaagggaaagtctctgaccttcgacctttatgccagcaaccagctcaggctcgaacctggtgcgttggtgaggcatggcgaatgcaaatttggaatggagtgatggcagtagctgttctgacggtgcccagaggctggaggtggtacctgtttcacgctagaaatataaatgtaataaactcatggatctggttgatgtaacctgcgccatggatgcacttgttcttttttggttccgatggatgggttgtttgcttgaaatgaaacctgcctgttcgaaatttggttatcactttttccatttatgtttttaattatttgtgtattaaagaaaatagttcacatagccgcaatatatgaccgaagctggcccgcaatgccgcaatagatgattaatttgtcaaacttagctatcaatatctcgatagaagtgcccacatgtttaaactaggcaaactcgttctccttgaaaactgataataaagacaagaaaattagcccactctaaaaagtcacatagcaaattcaacataaagaaaccagaagtcagaggaaagacttttaatccttgattatttgaacgaaatagccgcaatacgccaaagtgtcgccttcatgattgttcaataatttctgtagcaaatggaaaacgttttacaaacaatgtggccttggagtaataatcggaagaaaagttcataagtcagataatttgcgttgctgacactagtgaccaagcacctttaaatacctctgcttcccatgcatttttccaagttaacctaaagtggcagttgaatggctcgttatttcggtggtagctctcaacggcttcatgtcgatgattttcgtttgatcaaggagcccactcgactgaaggctcagcttgttaatgtggtggaaacctacaaggctgcacaaacagagacgttaaagtactatataccatctgcaactgagcgtgtggctcatatggaggcagtccatgtcaacaatgcagaaatggggctgcatccggccgggttcaagtatcctctgtccttcgtctttacctccctggccgtggctaaagcctgcaaggagaacaagcatctcgtgtgcgaggagcatttggagggagatctgatatcgtgcgtcgttcctccctatcagacaaatgtctcactcgctgctttaagggagatccacaattccatttcgggaggagggtaccggaatccaacagacatggattattttgtggcgatcttgccagatgaaaatttcgactatcagagctgtgaaattgtcaccaaaaatggcggcgaaggcctttgcaagatttatagcagacaactggaggggcccttagcttatgaggccatactggcaattggcaaggtcctgttggaataggcagtgcaccgctgatccaacgggagtttcgattatatttcgtattatcttacatgacttaagatcatgcatgtttcgcttgttctcccgtgtgtcggttacgttattgtgttaaaataacgggatgatgatatcaagtgctattgtaaaatatgttatattttgaatatctataatataagcgctgtgtgcgctcgatgggtagttaaatgatcatgatatatatttttgggtaatcaatcgcattgcagtgccgtgtgcttattgaagtaatatagtgttaaaattatttatttaatatctgataacatatcaaagggtacaacgtgataacaaagacggtggatacagcgtttattgggatatccgctggccagttatacgtaaataatacagacagagtttgagagagcacgcagattgtagccaagttgagtgacttgccggtagcaccgaagctaagctcaggtgttccaaattgactggcgtcgaggtgacgagcacgacgaccttgccggacaatgcggtcgcagggggctcaaggcgggtggcttgtaacggaccttgtgcttcttgttgtagctttcgttgagcataaccattgggaaggttgctgaacaacggtagcgcacctttttcaagcgagggtggcagaagaacatatttgcccgtcggcagacggcggtgagcatgacagctgctaagggagttactggaatcgcgtgagcggtgagcatgccgtcctgactatcggcgcccaatcaacaggacatcctcaacatgttttccaattccttgaaacctatctttatagcattgatctccaaccgatctcgattgaggccaaatttaatattcaaaagagagtttagtggaaatggaatataatcccgtggcggaagaagagccttcaaaaatggcagtccactaggacagtcaataatatccaaaaagcattgaaattgggttgggcacgagaggctgacgcggatgccactcgattgctaatggagtggttccttttctagcatatcgaatccatcgcttcactatatccttacctgattggctgagctgcgagaccaccaataacttccactaatatcgaaagtgtggctgctttgattatgatgctttgtgagaggttctctccccaataaagtcaagttgacagattcggatacgcccggttgagattttatttcattttttatctatttcgcatctcgaaaagttcacagaaatcaacaaggaggaggccaggtgtttaaataggttccagctgctctaaagtgatcagaagagaatttacagctggaggcacaaagcactaatcctgctaaagcatgagcatggcagatgagttggagcgtcaattggaaggcatttctctcgttacagtcctgggtccggatgtgagggccgagcttgaggcggcgctacgggactaccgcgatgatctcgacttctggaaaaggaacggttacgcggtggcggatctcgatcaatctgtgacggtcgacaagcttctttttatgtatatggatgaaccaatagcagacttgtgtgtaaagaatcgcatcctcgtttgcaacagcaattcagtcgcgaaaattacttcgcttccaccatacctgcctggggttacaagggccgaggcgtttgagaaacttaactccattgtttgtggaggtcctgcatctggatctcttcaatctgcttgttgcgactatttcgtggcgttcctccccagcaattgttttgagaagaccggtgagatatcggtgcgcacagtggacggcgagtgtggccccttcgatgtctttacccggcagcgtcagccagaggatcagagcgatatgttttttaagtatgaagagattgtatgtgctggaaagagtctatttttttgaaactagtgtgttttatctgtgtaacatgttatggagtctgatcgtatgatgtaatagctaaatttggtattaataatgattgatcgttatataagaattgttattaacataattaagtttagagtaaagcaagagggaaataaattaaaacactttattcagttacaaacaattatgaaaatacaaacataatacaaacataatacaaacgtcgcaggagaaagatgacaccgtaggatatttatgagccaaggatagacttgccagaaggcgagatcgtcctcatagcttagtgccttgggcgggccctaactggtgggctccatcttgagaaaaaacagctccttagtcaggaaggtggcttccagaacagcgcgaccaaccttatagatatcgtcggcatactccggcaggatctcaccgagaaccggtgtcgcaatatcttcggtgacttcaccatactggacgatgaccttgttgccggtgccctgggaatagcggatacggccgaccggagcatcgcactgccgttccttgacgttaacctttgcggtgctcacgacaggcgcccacgcgtacatggattcaccgctgacaacggcatggtcctgaacaaccgtgaagggcagagcttgaataaggtcgttgcagagttcggggttttccgttcgtcgcgagataggcaatgacgctgatgcccagcggctcccaggtaagccgtaccttttgaccgtcgcggatctgaacacgccgagagggatcggccagggccgcgatggaacttccggggtctcgtaagtgagatgttttccgatgctccaagggaagtaatggaatgaccaggcggccaaacggttgaggtaacccaggaacgccttgacggcctcaaccgcctcgtcgcggctaccagccgtcggaagatatttggtgatcgcttcggcaaaagcgcccatttcctgcaagccgctgtagcgcagatagttgctgtatgcgtagtcaaagcggtgcacgagtgcgcagcactgctcgagggtaaatcgctcatcctggaacgtcagcagcaacggataccacgtgtacatcgactggtcgcgcagcatgccgttcacgaagtcgaggttcgtgaagtattggttgtttgtcccgaccgcgaaggtgccggtccggatatcatgaagctccttcggtctcgatatggaggattgcctttgttgaaagcgtgatctctgcaacgagctgtcggaggtcgggagcgacttgcctgcaggccatgtgttatgaacaagaaggtggaagcaaatagatgatgttaggaaagggtgggattgcagggtgggcaggcacgatacttatagtggaaaaaggtatggagcaatttcgccgaaatctgggtgggccttctaaatattgggcgggccgcaccgtaactataattgcaggggcccaccaggttaattgcgtggccgcgttgattgggtgatattattacctaacatgagattgttatttgacaggatatatccccttgtctagttcgtcagttcgtcagttcgtcagttcgtcagttcgtcagttcgtcagttcgtcagttcgtcagttcgtcagttcgtcagttcgtcagttcgtcagttcgtcagttcgtcagttcgtcagttcgtcagttcgtcagttcattaacattgctccgcgcttgcctgatttgagaggttgtctctgcacgggtctgcagcgacatatggctacgaggacctaccttgccgatgagccgtatccatccggcgtagggcggggtttatgatctcggctcgtctgccatgatgcgttcgatcctttcgggatcacattgctcatcgacgcggaattgccggacaccgccctcgcaggtgcggataccggcgaggaattcctttaagctctcgatgccccggtcggtgaaggtcgtgacgccctcttggctgccgtcatgggcatggatcatctcgccgtaatcgatattgtctgagttgctggcgatttcctggaggaggttcgaggttctcgccgatcagcgaagcaacataatcgatcgtgtagacatgcgtctgtgggcggacaataaagtcttaaactgaacaaaatagatc

SEQ ID NO: 5 - DNA, 21 bp, Agrobacterium strain K599 (NCPPB 2659)
aatcgtcgatgcgaattgttg

SEQ ID NO: 6 - DNA, 23 bp, Agrobacterium strain K599 (NCPPB 2659)
gttttgtcctgacgctgtcgcga

SEQ ID NO: 7 - DNA, 23 bp, Agrobacterium strain K599 (NCPPB 2659)
tctaacgatcgctgcgctccgga

SEQ ID NO: 8 - DNA, 19 bp, Agrobacterium strain K599 (NCPPB 2659)
cgccacgaggcgcgacgga

SEQ ID NO: 9 - DNA, 20 bp, Agrobacterium strain K599 (NCPPB 2659)
ttatgggcgaattgatctga

SEQ ID NO: 10 - DNA, 22 bp, Agrobacterium strain K599 (NCPPB 2659)
gtcctgctaaggattgatgcct

SEQ ID NO: 11 - DNA, 20 bp, Agrobacterium strain K599 (NCPPB 2659)
agaccagtccttgtgaaacc

SEQ ID NO: 12 - DNA, 21 bp, Agrobacterium strain K599 (NCPPB 2659)
cctgggcatttttgttgttgg

SEQ ID NO: 13 - DNA, 20 bp, Agrobacterium strain K599 (NCPPB 2659)
aatggtatggcttcgaggtg

SEQ ID NO: 14 - DNA, 22 bp, Agrobacterium strain K599 (NCPPB 2659)
ctcaaagaagaccgtaccgaca

SEQ ID NO: 15 - DNA, 10632 bp, Artificial
  Binary vector pBPSEW008 [p-NOS::c-bar::t-NOS p-PcUBI::c-gusINT::t-NOS]
  misc_feature (274)..(488): complement: left T-DNA border
  terminator (506)..(758): complement: nos terminator
  misc_feature (800)..(1351): complement: bar gene (phosphinothricin resistance)
  promoter (1365)..(1652): complement: nos promoter
  promoter (1971)..(2966): parsley ubiquitin promoter
  Intron (2376)..(2963): intron from P.crispum gene
  misc_feature (2992)..(4992): gusINT gene, glucuronidase (GUS) gene with intron
  Intron (3377)..(3565): altered PIV2 intron from ST-LS1 gene
  terminator (5063)..(5315): nos terminator
  misc_feature (5374)..(5519): complement: right T-DNA border
  misc_feature (5684)..(6478): kanamycin (nptII) resistance gene
  rep_origin (6776)..(7057): ColE1 rep
  rep_origin (7866)..(8866): VS1-rep
cgctgcgctcaagtgcgcggtacagggtcgagcgatgcacgccaagcagtgcagccgcctctttcacggtgcggccttcctggtcgatcagctcgcgggcgtgcgcgatctgtgccggggtgagggtagggcgggggccaaacttcacgcctcgggccttggcggcctcgcgcccgctccgggtgcggtcgatgattagggaacgctcgaactcggcaatgccggcgaacacggtcaacaccatgcggccggccggcgtggtggtaacgcgtggtgattttgtgccgagctgccggtcggggagctgttggctggctggtggcaggatatattgtggtgtaaacaaattgacgcttagacaacttaataacacattgcggacgtctttaatgtactgaattaacatccgtttgatacttgtctaaaattggctgatttcgagtgcatctatgcataaaaacaatctaatgacaattattaccaagcaggatcctctagaattcccgatctagtaacatagatgacaccgcgcgcgataatttatcctagtttgcgcgctatattttgttttctatcgcgtattaaatgtataattgcgggactctaatcataaaaacccatctcataaataacgtcatgcattacatgttaattattacatgcttaacgtaattcaacagaaattatatgataatcatcgcaagaccggcaacaggattcaatcttaagaaactttattgccaaatgtttgaacgatcggggaaattcgagctcgccggcgtcgacgatatcctgcaggtcaaatctcggtgacgggcaggaccggacggggcggtaccggcaggctgaagtccagctgccagaaacccacgtcatgccagttcccgtgcttgaagccggccgcccgcagcatgccgcggggggcatatccgagcgcctcgtgcatgcgcacgctcgggtcgttgggcagcccgatgacagcgaccacgctcttgaagccctgtgcctccagggacttcagcaggtgggtgtagagcgtggagcccagtcccgtccgctggtggcggggggagacgtacacggtcgactcggccgtccagtcgtaggcgttgcgtgccttccaggggcccgcgtaggcgatgccggcgacctcgccgtccacctcggcgacgagccagggatagcgctcccgcagacggacgaggtcgtccgtccactcctgcggttcctgcggctcggtacggaagttgaccgtgcttgtctcgatgtagtggttgacgatggtgcagaccgccggcatgtccgcctcggtggcacggcggatgtcggccgggcgtcgttctgggctcatggcgcgccagatctggattgagagtgaatatgagactctaattggataccgaggggaatttatggaacgtcagtggagcatttttgacaagaaatatttgctagctgatagtgaccttaggcgacttttgaacgcgcaataatggtttctgacgtatgtgcttagctcattaaactccagaaacccgcggctgagtggctccttcaacgttgcggttctgtcagttccaaacgtaaaacggcttgtcccgcgtcatcggcgggggtcataacgtgactcccttaattctccgctcatgatcttgatcccctgcgccatcagatccttggcggcaagaaagccatccagtttactttgcagggcttcccaaccttaccagagggcgccccagctggcaattccggttcgcttgctgtccataaaaccgcccagtctagctatcgccatgtaagcccactgcaagctacctgctttctctttgcgcttgcgttttcccttgtccagatagcccagtagctgacattcatccggggtcagcaccgtttctgcggactggctttctacgtgttccgcttcctttagcagcccttgcgccctgagtgcttgcggcagcgtgaagcttgactagagaattcgaatccaaaaattacggatatgaatataggcatatccgtatccgaattatccgtttgacagctagcaacgattgtacaattgcttctttaaaaaaggaagaaagaaagaaagaaaagaatcaacatcagcgttaacaaacggccccgttacggcccaaacggtcatatagagtaacggcgttaagcgttgaaagactcctatcgaaatacgtaaccgcaaacgtgtcatagtcagatcccctcttccttcaccgcctcaaacacaaaaataatcttctacagcctatatatacaacccccccttctatctctcctttctcacaattcatcatctttctttctctacccccaattttaagaaatcctctcttctcctcttcattttcaaggtaaatctctctctctctctctctctctgttattccttgttttaattaggtatgtattattgctagtttgttaatctgcttatcttatgtatgccttatgtgaatatctttatcttgttcatctcatccgtttagaagctataaatttgttgatttgactgtgtatctacacgtggttatgtttatatctaatcagatatgaatttcttcatattgttgcgtttgtgtgtaccaatccgaaatcgttgatttttttcatttaatcgtgtagctaattgtacgtatacatatggatctacgtatcaattgttcatctgtttgtgtttgtatgtatacagatctgaaaacatcacttctctcatctgattgtgttgttacatacatagatatagatctgttatatcattttttttattaattgtgtatatatatatgtgcatagatctggattacatgattgtgattatttacatgattttgttatttacgtatgtatatatgtagatctggactttttggagttgttgacttgattgtatttgtgtgtgtatatgtgtgttctgatcttgatatgttatgtatgtgcagcccggatctccgggtaggtcagtcccttatgttacgtcctgtagaaaccccaacccgtgaaatcaaaaaactcgacggcctgtgggcattcagtctggatcgcgaaaactgtggaattggtcagcgttggtgggaaagcgcgttacaagaaagccgggcaattgctgtgccaggcagttttaacgatcagttcgccgatgcagatattcgtaattatgcgggcaacgtctggtatcagcgcgaagtctttataccgaaaggttgggcaggccagcgtatcgtgctgcgtttcgatgcggtcactcattacggcaaagtgtgggtcaataatcaggaagtgatggagcatcagggcggctatacgccatttgaagccgatgtcacgccgtatgttattgccgggaaaagtgtacgtaagtttctgcttctacctttgatatatatataataattatcattaattagtagtaatataatatttcaaatatttttttcaaaataaaagaatgtagtatatagcaattgcttttctgtagtttataagtgtgtatattttaatttataacttttctaatatatgaccaaaatttgttgatgtgcaggtatcaccgtttgtgtgaacaacgaactgaactggcagactatcccgccgggaatggtgattaccgacgaaaacggcaagaaaaagcagtcttacttccatgatttctttaactatgccggaatccatcgcagcgtaatgctctacaccacgccgaacacctgggtggacgatatcaccgtggtgacgcatgtcgcgcaagactgtaaccacgcgtctgttgactggcaggtggtggccaatggtgatgtcagcgttgaactgcgtgatgcggatcaacaggtggttgcaactggacaaggcactagcgggactttgcaagtggtgaatccgcacctctggcaaccgggtgaaggttatctctatgaactgtgcgtcacagccaaaagccagacagagtgtgatatctacccgcttcgcgtcggcatccggtcagtggcagtgaagggcgaacagttcctgattaaccacaaaccgttctactttactggctttggtcgtcatgaagatgcggacttgcgtggcaaaggattcgataacgtgctgatggtgcacgaccacgcattaatggactggattggggccaactcctaccgtacctcgcattacccttacgctgaagagatgctcgactgggcagatgaacatggcatcgtggtgattgatgaaactgctgctgtcggctttaacctctctttaggcattggtttcgaagcgggcaacaagccgaaagaactgtacagcgaagaggcagtcaacggggaaactcagcaagcgcacttacaggcgattaaagagctgatagcgcgtgacaaaaaccacccaagcgtggtgatgtggagtattgccaacgaaccggatacccgtccgcaaggtgcacgggaatatttcgcgccactggcggaagcaacgcgtaaactcgacccgacgcgtccgatcacctgcgtcaatgtaatgttctgcgacgctcacaccgataccatcagcgatctctttgatgtgctgtgcctgaaccgttattacggatggtatgtccaaagcggcgatttggaaacggcagagaaggtactggaaaaagaacttctggcctggcaggagaaactgcatcagccgattatcatcaccgaatacggcgtggatacgttagccgggctgcactcaatgtacaccgacatgtggagtgaagagtatcagtgtgcatggctggatatgtatcaccgcgtctttgatcgcgtcagcgccgtcgtcggtgaacaggtatggaatttcgccgattttgcgacctcgcaaggcatattgcgcgttggcggtaacaagaaagggatcttcactcgcgaccgcaaaccgaagtcggcggcttttctgctgcaaaaacgctggactggcatgaacttcggtgaaaaaccgcagcagggaggcaaacaatgaatcaacaactctcctggcgcaccatcgtcggctacagcctcgggaattgctaccgagctcgaatttccccgatcgttcaaacatttggcaataaagtttcttaagattgaatcctgttgccggtcttgcgatgattatcatataatttctgttgaattacgttaagcatgtaataattaacatgtaatgcatgacgttatttatgagatgggtttttatgattagagtcccgcaattatacatttaatacgcgatagaaaacaaaatatagcgcgcaaactaggataaattatcgcgcgcggtgtcatctatgttactagatcgggaattggcgatcgcagcttggcgtaatcatggtcatagctgtttcctactagatctgattgtcgtttcccgccttcagtttaaactatcagtgtttgacaggatatattggcgggtaaacctaagagaaaagagcgtttattagaataatcggatatttaaaagggcgtgaaaaggtttatccgttcgtccatttgtatgtccatgtgttttatggacagcaagcgaaccggaattgccagctggggcgccctctggtaaggttgggaagccctgcaaagtaaactggatggctttcttgccgccaaggatctgatggcgcaggggatcaagatctgatcaagagacaggatgaggatcgtttcgcatgattgaacaagatggattgcacgcaggttctccggccgcttgggtggagaggctattcggctatgactgggcacaacagacaatcggctgctctgatgccgccgtgttccggctgtcagcgcaggggcgcccggttctttttgtcaagaccgacctgtccggtgccctgaatgaactgcaggacgaggcagcgcggctatcgtggctggccacgacgggcgttccttgcgcagctgtgctcgacgttgtcactgaagcgggaagggactggctgctattgggcgaagtgccggggcaggatctcctgtcatcccaccttgctcctgccgagaaagtatccatcatggctgatgcaatgcggcggctgcatacgcttgatccggctacctgcccattcgaccaccaagcgaaacatcgcatcgagcgagcacgtactcggatggaagccggtcttgtcgatcaggatgatctggacgaagagcatcaggggctcgcgccagccgaactgttcgccaggctcaaggcgcgcatgcccgacggcgaggatctcgtcgtgacccatggcgatgcctgcttgccgaatatcatggtggaaaatggccgcttttctggattcatcgactgtggccggctgggtgtggcggaccgctatcaggacatagcgttggctacccgtgatattgctgaagagcttggcggcgaatgggctgaccgcttcctcgtgctttacggtatcgccgctcccgattcgcagcgcatcgccttctatcgccttcttgacgagttcttctgaattgaaaaaggaagaatgcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgtccttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgttctttcctgcgttatcccctgattctgtggataaccgtattaccgcctttgagtgagctgataccgctcgccgcagccgaacgaccgagcgcagcgagtcagtgagcgaggaagcggaagagcgcctgatgcggtattttctccttacgcatctgtgcggtatttcacaccgcatatggtgcactctcagtacaatctgctctgatgccgcatagttaagccagtatacactccgctatcgctacgtgactgggtcatggctgcgccccgacacccgccaacacccgctgacgcgccctgacgggcttgtctgctcccggcatccgcttacagacaagctgtgaccgtctccgggagctgcatgtgtcagaggttttcaccgtcatcaccgaaacgcgcgaggcagggtgccttgatgtgggcgccggcggtcgagtggcgacggcgcggcttgtccgcgccctggtagattgcctggccgtaggccagccatttttgagcggccagcggccgcgataggccgacgcgaagcggcggggcgtagggagcgcagcgaccgaagggtaggcgctttttgcagctcttcggctgtgcgctggccagacagttatgcacaggccaggcgggttttaagagttttaataagttttaaagagttttaggcggaaaaatcgccttttttctcttttatatcagtcacttacatgtgtgaccggttcccaatgtacggctttgggttcccaatgtacgggttccggttcccaatgtacggctttgggttcccaatgtacgtgctatccacaggaaagagaccttttcgacctttttcccctgctagggcaatttgccctagcatctgctccgtacattaggaaccggcggatgcttcgccctcgatcaggttgcggtagcgcatgactaggatcgggccagcctgccccgcctcctccttcaaatcgtactccggcaggtcatttgacccgatcagcttgcgcacggtgaaacagaacttcttgaactctccggcgctgccactgcgttcgtagatcgtcttgaacaaccatctggcttctgccttgcctgcggcgcggcgtgccaggcggtagagaaaacggccgatgccgggatcgatcaaaaagtaatcggggtgaaccgtcagcacgtccgggttcttgccttctgtgatctcgcggtacatccaatcagctagctcgatctcgatgtactccggccgcccggtttcgctctttacgatcttgtagcggctaatcaaggcttcaccctcggataccgtcaccaggcggccgttcttggccttcttcgtacgctgcatggcaacgtgcgtggtgtttaaccgaatgcaggtttctaccaggtcgtctttctgctttccgccatcggctcgccggcagaacttgagtacgtccgcaacgtgtggacggaacacgcggccgggcttgtctcccttcccttcccggtatcggttcatggattcggttagatgggaaaccgccatcagtaccaggtcgtaatcccacacactggccatgccggccggccctgcggaaacctctacgtgcccgtctggaagctcgtagcggatcacctcgccagctcgtcggtcacgcttcgacagacggaaaacggccacgtccatgatgctgcgactatcgcgggtgcccacgtcatagagcatcggaacgaaaaaatctggttgctcgtcgcccttgggcggcttcctaatcgacggcgcaccggctgccggcggttgccgggattctttgcggattcgatcagcggccgcttgccacgattcaccggggcgtgcttctgcctcgatgcgttgccgctgggcggcctgcgcggccttcaacttctccaccaggtcatcacccagcgccgcgccgatttgtaccgggccggatggtttgcgaccgctcacgccgattcctcgggcttgggggttccagtgccattgcagggccggcagacaacccagccgcttacgcctggccaaccgcccgttcctccacacatggggcattccacggcgtcggtgcctggttgttcttgattttccatgccgcctcctttagccgctaaaattcatctactcatttattcatttgctcatttactctggtagctgcgcgatgtattcagatagcagctcggtaatggtcttgccttggcgtaccgcgtacatcttcagcttggtgtgatcctccgccggcaactgaaagttgacccgcttcatggctggcgtgtctgccaggctggccaacgttgcagccttgctgctgcgtgcgctcggacggccggcacttagcgtgtttgtgcttttgctcattttctctttacctcattaactcaaatgagttttgatttaatttcagcggccagcgcctggacctcgcgggcagcgtcgccctcgggttctgattcaagaacggttgtgccggcggcggcagtgcctgggtagctcacgcgctgcgtgatacgggactcaagaatgggcagctcgtacccggccagcgcctcggcaacctcaccgccgatgcgcgtgcctttgatcgcccgcgacacgacaaaggccgcttgtagccttccatccgtgacctcaatgcgctgcttaaccagctccaccaggtcggcggtggcccatatgtcgtaagggcttggctgcaccggaatcagcacgaagtcggctgccttgatcgcggacacagccaagtccgccgcctggggcgctccgtcgatcactacgaagtcgcgccggccgatggccttcacgtcgcggtcaatcgtcgggcggtcgatgccgacaacggttagcggttgatcttcccgcacggccgcccaatcgcgggcactgccctggggatcggaatcgactaacagaacatcggccccggcgagttgcagggcgcgggctagatgggttgcgatggtcgtcttgcctgacccgcctttctggttaagtacagcgataaccttcatgcgttccccttgcgtatttgtttatttactcatcgcatcatatacgcagcgaccgcatgacgcaagctgttttactcaaatacacatcacctttttagacggcggcgctcggtttcttcagcggccaagctggccggccaggccgccagcttggcatcagacaaaccggccaggatttcatgcagccgcacggttgagacgtgcgcgggcggctcgaacacgtacccggccgcgatcatctccgcctcgatctcttcggtaatgaaaaacggttcgtcctggccgtcctggtgcggtttcatgcttgttcctcttggcgttcattctcggcggccgccagggcgtcggcctcggtcaatgcgtcctcacggaaggcaccgcgccgcctggcctcggtgggcgtcacttcct

SEQ ID NO: 16 - DNA, 17396 bp, Artificial
  Nucleic acid sequence enconding binary vector pBPSMM192b [p-AtAhas::c-csr1-2::t-AtAHAS t-NOS::c-gusINT::p-SUPER]
  misc_feature (7)..(32): T-DNA left border
  promoter (231)..(2707): AHAS promoter
  misc_feature (2708)..(4720): mutated AHAS csr1-2 selection marker gene
  terminator (4721)..(5936): Arabidopsis thaliana AHAS 3' UTR and terminator
  terminator (6231)..(6500): complement: nos terminator
  misc_feature (6561)..(8561): complement: gusINT gene, coding for glucuronidase (GUS) gene with intron
  promoter (8581)..(9727): complement: SUPER promoter
  misc_feature (9805)..(9830): T-DNA right border
  rep_origin (12453)..(13465): complement: VS1-rep region
  rep_origin (14275)..(14555): complement: ColE1 rep
  misc_feature (16184)..(16978): Kanamycin E.coli selection gene (nptIII)
ggctggtggcaggatatattgtggtgtaaacaaattgacgcttagacaacttaataacacattgcggacgtttttaatgtactgaattaacgccgaattaagctcaattgactagtggcgcgcccacgtgttaattaacggtccgaggcctcctcagcaagctgttaacgcgatcgcgctgaggcggaccgcacgtggaattcgagctcggtacccggggatcctctagattatgtatttccaactttcattaacaatataatcgcatataaatgaaaaatcgtttccaggataatattttgatgaaatctcatattattgttcgtactcggattgatgttgaaggcttgaagcgcttcaaattatagaccagattatttaagtttttcttttgtttactccatatcaatttgatccattatactacctaagaaaatttaggtaacatagaattatttattgttatagtaaaaaaaaggaaaaccacaaaaataatctacttttacgtatatactattttcatgacataagtaattaagttgtacaacttttttttaatgaaaagagagagtaaatttatcatgttcatgtgtagttacctcgtgaataaccgacggttatatagacgcctaacatgaattgttcagttgaagacagttcaaaacatgtgtttcactctaaaatcctcaacaaaaaaaaagtgttaaaatttgtaaacctctttcaagcaaaaaaagaaaaagtgttagaatcccaagattctttcataatccggaatcttggctgaaaacgtataaaagagattgacgtagtaacaaggagtcttggtatgcttccatgctttttatccttttttgtcatggaaccatgatttggttaccatttattatgtaaccgaaattttcattgtaataatgaatatttaaatttttagcaaaaaaaaacaaaaaaaaacaaggagtcttgtcttcgttctcaaatttcagagctcttgcacttttcaagagttttactttgatgagtgagacatttgtctttttagtgtttattttctaaacttaaaatagtagcatcaacatcactcaattataattcttaagatgttgtagaaaaatattttatagatggaaagtaatcgatattaagacaaataagaaaccaaaccggactttgtgttcagaccgaatcaaatctgaattggagaaattatggtggaggcgaaagtcaacggaactaaagtataaaaccaaatgtcaaaaataaaacccaattttcatccttaaacgaacctgctgaaaccctaatttcgattaccaattccgatctaaaaagaagtcatggaagccattgattccgcaatcgatcctctcagagatttcgctaagagcagtgttcgtctcgtccagcgctgtcacaaacccgatcgcaagggtaacgccttttctcaaaaaaatctcatttccgatttttgatctgtagattagggttttctgaaattttgatatcatttgtaattgaattggttatcagaattcacgaaagtagctgtgcgtacggcgattggatttgtggtgatgggattcgttggattcttcgtgaagctcgttttcatcccaatcaacaacatcatcgttggatcttcttagtgtagtactttctttacgaggtaattgatctcgcattatatatctacattttggttatgttacttgacatatagtcattgattcaatagttctgttaattcctttaaagatcattttgactagaccacattcttggttcattcctcaataatttgtaatcatattggtggatatagaagtagattggttatagatcagatagtggaagactttaggatgaatttcagctagtttttttttttggcttattgtctcaaaagattagtgctttgctgtctccattgcttctgctatcgacacgcttctgtctccttgtatctttattatatctattcgtcccatgagttttgtttgttctgtattcgttcgctctggtgtcatggatggagtctctgttccatgtttctgtaatgcatgttgggttgtttcatgcaagaaatgctgagataaacactcatttgtgaaagtttctaaactctgaatcgcgctacaggcaatgctccgaggagtaggaggagaagaacgaaccaaacgacattatcagccctttgaggaagctcttagttttgttattgtttttgtagccaaattctccattcttattccattttcacttatctcttgttccttatagaccttataagttttttattcatgtatacaaattatattgtcatcaagaagtatctttaaaatctaaatctcaaatcaccaggactatgtttttgtccaattcgtggaaccaacttgcagcttgtatccattctcttaaccaataaaaaaagaaagaaagatcaatttgataaatttctcagccacaaattctacatttaggttttagcatatcgaaggctcaatcacaaatacaatagatagactagagattccagcgtcacgtgagttttatctataaataaaggaccaaaaatcaaatcccgagggcattttcgtaatccaacataaaacccttaaacttcaagtctcatttttaaacaaatcatgttcacaagtctcttcttcttctctgtttctctatctcttgctcatctttctcctgaaccatggcggcggcaacaacaacaacaacaacatcttcttcgatctccttctccaccaaaccatctccttcctcctccaaatcaccattaccaatctccagattctccctcccattctccctaaaccccaacaaatcatcctcctcctcccgccgccgcggtatcaaatccagctctccctcctccatctccgccgtgctcaacacaaccaccaatgtcacaaccactccctctccaaccaaacctaccaaacccgaaacattcatctcccgattcgctccagatcaaccccgcaaaggcgctgatatcctcgtcgaagctttagaacgtcaaggcgtagaaaccgtattcgcttaccctggaggtgcatcaatggagattcaccaagccttaacccgctcttcctcaatccgtaacgtccttcctcgtcacgaacaaggaggtgtattcgcagcagaaggatacgctcgatcctcaggtaaaccaggtatctgtatagccacttcaggtcccggagctacaaatctcgttagcggattagccgatgcgttgttagatagtgttcctcttgtagcaatcacaggacaagtccctcgtcgtatgattggtacagatgcgtttcaagagactccgattgttgaggtaacgcgttcgattacgaagcataactatcttgtgatggatgttgaagatatccctaggattattgaggaagctttctttttagctacttctggtagacctggacctgttttggttgatgttcctaaagatattcaacaacagcttgcgattcctaattgggaacaggctatgagattacctggttatatgtctaggatgcctaaacctccggaagattctcatttggagcagattgttaggttgatttctgagtctaagaagcctgtgttgtatgttggtggtggttgtttgaattctagcgatgaattgggtaggtttgttgagcttacggggatccctgttgcgagtacgttgatggggctgggatcttatccttgtgatgatgagttgtcgttacatatgcttggaatgcatgggactgtgtatgcaaattacgctgtggagcatagtgatttgttgttggcgtttggggtaaggtttgatgatcgtgtcacgggtaagcttgaggcttttgctagtagggctaagattgttcatattgatattgactcggctgagattgggaagaataagactcctcatgtgtctgtgtgtggtgatgttaagctggctttgcaagggatgaataaggttcttgagaaccgagcggaggagcttaagcttgattttggagtttggaggaatgagttgaacgtacagaaacagaagtttccgttgagctttaagacgtttggggaagctattcctccacagtatgcgattaaggtccttgatgagttgactgatggaaaagccataataagtactggtgtcgggcaacatcaaatgtgggcggcgcagttctacaattacaagaaaccaaggcagtggctatcatcaggaggccttggagctatgggatttggacttcctgctgcgattggagcgtctgttgctaaccctgatgcgatagttgtggatattgacggagatggaagctttataatgaatgtgcaagagctagccactattcgtgtagagaatcttccagtgaaggtacttttattaaacaaccagcatcttggcatggttatgcaatgggaagatcggttctacaaagctaaccgagctcacacatttctcggggatccggctcaggaggacgagatattcccgaacatgttgctgtttgcagcagcttgcgggattccagcggcgagggtgacaaagaaagcagatctccgagaagctattcagacaatgctggatacaccaggaccttacctgttggatgtgatttgtccgcaccaagaacatgtgttgccgatgatcccgaatggtggcactttcaacgatgtcataacggaaggagatggccggattaaatactgagagatgaaaccggtgattatcagaaccttttatggtctttgtatgcatatggtaaaaaaacttagtttgcaatttcctgtttgttttggtaatttgagtttcttttagttgttgatctgcctgctttttggtttacgtcagactactactgctgttgttgtttggtttcctttctttcattttataaataaataatccggttcggtttactccttgtgactggctcagtttggttattgcgaaatgcgaatggtaaattgagtaattgaaattcgttattagggttctaagctgttttaacagtcactgggttaatatctctcgaatcttgcatggaaaatgctcttaccattggtttttaattgaaatgtgctcatatgggccgtggtttccaaattaaataaaactacgatgtcatcgagaagtaaaatcaactgtgtccacattatcagttttgtgtatacgatgaaatagggtaattcaaaatctagcttgatatgccttttggttcattttaaccttctgtaaacattttttcagattttgaacaagtaaatccaaaaaaaaaaaaaaaaaatctcaactcaacactaaattattttaatgtataaaagatgcttaaaacatttggcttaaaagaaagaagctaaaaacatagagaactcttgtaaattgaagtatgaaaatatactgaattgggtattatatgaatttttctgatttaggattcacatgatccaaaaaggaaatccagaagcactaatcagacattggaagtaggaatatttcaaaaagttttttttttttaagtaagtgacaaaagcttttaaaaaatagaaaagaaactagtattaaagttgtaaatttaataaacaaaagaaattttttatattttttcatttctttttccagcatgaggttatgatggcaggatgtggatttcatttttttccttttgatagccttttaattgatctattataattgacgaaaaaatattagttaattatagatatattttaggtagtattagcaatttacacttccaaaagactatgtaagttgtaaatatgatgcgttgatctcttcatcattcaatggttagtcaaaaaaataaaagcttaactagtaaactaaagtagtcaaaaattgtactttagtttaaaatattacatgaataatccaaaacgacatttatgtgaaacaaaaacaatatctagagtcgacctgcaggcatgcaagcttggcgcgccttaattaaaggcctgttaacagcgctgggcccgtttaaactgaaggcgggaaacgacaatctgatccaagctcaagctgctctagcattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgtaaaacgacggccagtgccaagcttgcatgccaattcccgatctagtaacatagatgacaccgcgcgcgataatttatcctagtttgcgcgctatattttgttttctatcgcgtattaaatgtataattgcgggactctaatcataaaaacccatctcataaataacgtcatgcattacatgttaattattacatgcttaacgtaattcaacagaaattatatgataatcatcgcaagaccggcaacaggattcaatcttaagaaactttattgccaaatgtttgaacgatcggggaaattcgagctcggtagcaattcccgaggctgtagccgacgatggtgcgccaggagagttgttgattcattgtttgcctccctgctgcggtttttcaccgaagttcatgccagtccagcgtttttgcagcagaaaagccgccgacttcggtttgcggtcgcgagtgaagatccctttcttgttaccgccaacgcgcaatatgccttgcgaggtcgcaaaatcggcgaaattccatacctgttcaccgacgacggcgctgacgcgatcaaagacgcggtgatacatatccagccatgcacactgatactcttcactccacatgtcggtgtacattgagtgcagcccggctaacgtatccacgccgtattcggtgatgataatcggctgatgcagtttctcctgccaggccagaagttctttttccagtaccttctctgccgtttccaaatcgccgctttggacataccatccgtaataacggttcaggcacagcacatcaaagagatcgctgatggtatcggtgtgagcgtcgcagaacattacattgacgcaggtgatcggacgcgtcgggtcgagtttacgcgttgcttccgccagtggcgcgaaatattcccgtgcaccttgcggacgggtatccggttcgttggcaatactccacatcaccacgcttgggtggtttttgtcacgcgctatcagctctttaatcgcctgtaagtgcgcttgctgagtttccccgttgactgcctcttcgctgtacagttctttcggcttgttgcccgcttcgaaaccaatgcctaaagagaggttaaagccgacagcagcagtttcatcaatcaccacgatgccatgttcatctgcccagtcgagcatctcttcagcgtaagggtaatgcgaggtacggtaggagttggccccaatccagtccattaatgcgtggtcgtgcaccatcagcacgttatcgaatcctttgccacgcaagtccgcatcttcatgacgaccaaagccagtaaagtagaacggtttgtggttaatcaggaactgttcgcccttcactgccactgaccggatgccgacgcgaagcgggtagatatcacactctgtctggcttttggctgtgacgcacagttcatagagataaccttcacccggttgccagaggtgcggattcaccacttgcaaagtcccgctagtgccttgtccagttgcaaccacctgttgatccgcatcacgcagttcaacgctgacatcaccattggccaccacctgccagtcaacagacgcgtggttacagtcttgcgcgacatgcgtcaccacggtgatatcgtccacccaggtgttcggcgtggtgtagagcattacgctgcgatggattccggcatagttaaagaaatcatggaagtaagactgctttttcttgccgttttcgtcggtaatcaccattcccggcgggatagtctgccagttcagttcgttgttcacacaaacggtgatacctgcacatcaacaaattttggtcatatattagaaaagttataaattaaaatatacacacttataaactacagaaaagcaattgctatatactacattcttttattttgaaaaaaatatttgaaatattatattactactaattaatgataattattatatatatatcaaaggtagaagcagaaacttacgtacacttttcccggcaataacatacggcgtgacatcggcttcaaatggcgtatagccgccctgatgctccatcacttcctgattattgacccacactttgccgtaatgagtgaccgcatcgaaacgcagcacgatacgctggcctgcccaacctttcggtataaagacttcgcgctgataccagacgttgcccgcataattacgaatatctgcatcggcgaactgatcgttaaaactgcctggcacagcaattgcccggctttcttgtaacgcgctttcccaccaacgctgaccaattccacagttttcgcgatccagactgaatgcccacaggccgtcgagttttttgatttcacgggttggggtttctacaggacgtaacataagggactgacctacccgggagatcttcgatttggtgtatcgagattggttatgaaattcagatgctagtgtaatgtattggtaatttgggaagatataataggaagcaaggctatttatccatttctgaaaaggcgaaatggcgtcaccgcgagcgtcacgcgcattccgttcttgctgtaaagcgttgtttggtacacttttgactagcgaggcttggcgtgtcagcgtatctattcaaaagtcgttaatggctgcggatcaagaaaaagttggaatagaaacagaatacccgcgaaattcaggcccggttgccatgtcctacacgccgaaataaacgaccaaattagtagaaaaataaaaactgactcggatacttacgtcacgtcttgcgcactgatttgaaaaatctccctcgatcgagaaagagatcaatgttgagctgcttcaaaagcaatgggattgaccagctcgcggatcctacaggccaaattcgctcttagccgtacaatattactcaccggtgcgatgccccccatcgtaggtgaaggtggaaattaatgatccatcttgagaccacaggcccacaacagctaccagtttcctcaagggtccaccaaaaacgtaagcgcttacgtacatggtcgataagaaaaggcaatttgtagatgttaacatccaacgtcgctttcagggatcctacaggccaaattcgctcttagccgtacaatattactcaccggtgcgatgccccccatcgtaggtgaaggtggaaattaatgatccatcttgagaccacaggcccacaacagctaccagtttcctcaagggtccaccaaaaacgtaagcgcttacgtacatggtcgataagaaaaggcaatttgtagatgttaacatccaacgtcgctttcagggatcctacaggccaaattcgctcttagccgtacaatattactcaccggtgcgatgccccccatcgtaggtgaaggtggaaattaatgatccatcttgagaccacaggcccacaacagctaccagtttcctcaagggtccaccaaaaacgtaagcgcttacgtacatggtcgataagaaaaggcaatttgtagatgttaacatccaacgtcgctttcagggatccgcgagcttatcgataccgtcgaatctagagtcgacctgcaggcatgcaagcttggcgcgccttaattaaaggaaactatcagtgtttgacaggatatattggcgggtaaacctaagagaaaagagcgtttattagaataacggatatttaaaagggcgtgaaaaggtttatccgttcgtccatttgtatgtgcatgccaaccacagggttcccctcgggatcaaagtactttgatccaacccctccgctgctatagtgcagtcggcttctgacgttcagtgcagccgtcttctgaaaacgacatgtcgcacaagtcctaagttacgcgacaggctgccgccctgcccttttcctggcgttttcttgtcgcgtgttttagtcgcataaagtagaatacttgcgactagaaccggagacattacgccatgaacaagagcgccgccgctggcctgctgggctatgcccgcgtcagcaccgacgaccaggacttgaccaaccaacgggccgaactgcacgcggccggctgcaccaagctgttttccgagaagatcaccggcaccaggcgcgaccgcccggagctggccaggatgcttgaccacctacgccctggcgacgttgtgacagtgaccaggctagaccgcctggcccgcagcacccgcgacctactggacattgccgagcgcatccaggaggccggcgcgggcctgcgtagcctggcagagccgtgggccgacaccaccacgccggccggccgcatggtgttgaccgtgttcgccggcattgccgagttcgagcgttccctaatcatcgaccgcacccggagcgggcgcgaggccgccaaggcccgaggcgtgaagtttggcccccgccctaccctcaccccggcacagatcgcgcacgcccgcgagctgatcgaccaggaaggccgcaccgtgaaagaggcggctgcactgcttggcgtgcatcgctcgaccctgtaccgcgcacttgagcgcagcgaggaagtgacgcccaccgaggccaggcggcgcggtgccttccgtgaggacgcattgaccgaggccgacgccctggcggccgccgagaatgaacgccaagaggaacaagcatgaaaccgcaccaggacggccaggacgaaccgtttttcattaccgaagagatcgaggcggagatgatcgcggccgggtacgtgttcgagccgcccgcgcacgtctcaaccgtgcggctgcatgaaatcctggccggtttgtctgatgccaagctggcggcctggccggccagcttggccgctgaagaaaccgagcgccgccgtctaaaaaggtgatgtgtatttgagtaaaacagcttgcgtcatgcggtcgctgcgtatatgatgcgatgagtaaataaacaaatacgcaaggggaacgcatgaaggttatcgctgtacttaaccagaaaggcgggtcaggcaagacgaccatcgcaacccatctagcccgcgccctgcaactcgccggggccgatgttctgttagtcgattccgatccccagggcagtgcccgcgattgggcggccgtgcgggaagatcaaccgctaaccgttgtcggcatcgaccgcccgacgattgaccgcgacgtgaaggccatcggccggcgcgacttcgtagtgatcgacggagcgccccaggcggcggacttggctgtgtccgcgatcaaggcagccgacttcgtgctgattccggtgcagccaagcccttacgacatatgggccaccgccgacctggtggagctggttaagcagcgcattgaggtcacggatggaaggctacaagcggcctttgtcgtgtcgcgggcgatcaaaggcacgcgcatcggcggtgaggttgccgaggcgctggccgggtacgagctgcccattcttgagtcccgtatcacgcagcgcgtgagctacccaggcactgccgccgccggcacaaccgttcttgaatcagaacccgagggcgacgctgcccgcgaggtccaggcgctggccgctgaaattaaatcaaaactcatttgagttaatgaggtaaagagaaaatgagcaaaagcacaaacacgctaagtgccggccgtccgagcgcacgcagcagcaaggctgcaacgttggccagcctggcagacacgccagccatgaagcgggtcaactttcagttgccggcggaggatcacaccaagctgaagatgtacgcggtacgccaaggcaagaccattaccgagctgctatctgaatacatcgcgcagctaccagagtaaatgagcaaatgaataaatgagtagatgaattttagcggctaaaggaggcggcatggaaaatcaagaacaaccaggcaccgacgccgtggaatgccccatgtgtggaggaacgggcggttggccaggcgtaagcggctgggttgcctgccggccctgcaatggcactggaacccccaagcccgaggaatcggcgtgagcggtcgcaaaccatccggcccggtacaaatcggcgcggcgctgggtgatgacctggtggagaagttgaaggccgcgcaggccgcccagcggcaacgcatcgaggcagaagcacgccccggtgaatcgtggcaagcggccgctgatcgaatccgcaaagaatcccggcaaccgccggcagccggtgcgccgtcgattaggaagccgcccaagggcgacgagcaaccagattttttcgttccgatgctctatgacgtgggcacccgcgatagtcgcagcatcatggacgtggccgttttccgtctgtcgaagcgtgaccgacgagctggcgaggtgatccgctacgagcttccagacgggcacgtagaggtttccgcagggccggccggcatggccagtgtgtgggattacgacctggtactgatggcggtttcccatctaaccgaatccatgaaccgataccgggaagggaagggagacaagcccggccgcgtgttccgtccacacgttgcggacgtactcaagttctgccggcgagccgatggcggaaagcagaaagacgacctggtagaaacctgcattcggttaaacaccacgcacgttgccatgcagcgtacgaagaaggccaagaacggccgcctggtgacggtatccgagggtgaagccttgattagccgctacaagatcgtaaagagcgaaaccgggcggccggagtacatcgagatcgagctagctgattggatgtaccgcgagatcacagaaggcaagaacccggacgtgctgacggttcaccccgattactttttgatcgatcccggcatcggccgttttctctaccgcctggcacgccgcgccgcaggcaaggcagaagccagatggttgttcaagacgatctacgaacgcagtggcagcgccggagagttcaagaagttctgtttcaccgtgcgcaagctgatcgggtcaaatgacctgccggagtacgatttgaaggaggaggcggggcaggctggcccgatcctagtcatgcgctaccgcaacctgatcgagggcgaagcatccgccggttcctaatgtacggagcagatgctagggcaaattgccctagcaggggaaaaaggtcgaaaaggtctctttcctgtggatagcacgtacattgggaacccaaagccgtacattgggaaccggaacccgtacattgggaacccaaagccgtacattgggaaccggtcacacatgtaagtgactgatataaaagagaaaaaaggcgatttttccgcctaaaactctttaaaacttattaaaactcttaaaacccgcctggcctgtgcataactgtctggccagcgcacagccgaagagctgcaaaaagcgcctacccttcggtcgctgcgctccctacgccccgccgcttcgcgtcggcctatcgcggccgctggccgctcaaaaatggctggcctacggccaggcaatctaccagggcgcggacaagccgcgccgtcgccactcgaccgccggcgcccacatcaaggcaccctgcctcgcgcgtttcggtgatgacggtgaaaacctctgacacatgcagctcccggagacggtcacagcttgtctgtaagcggatgccgggagcagacaagcccgtcagggcgcgtcagcgggtgttggcgggtgtcggggcgcagccatgacccagtcacgtagcgatagcggagtgtatactggcttaactatgcggcatcagagcagattgtactgagagtgcaccatatgcggtgtgaaataccgcacagatgcgtaaggagaaaataccgcatcaggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaaggacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggctgatgaatcccctaatgatttttatcaaaatcattaagttaaggtagatacacatcttgtcatatgatcaaatggtttcgccaaaaatcaataatcagacaacaaaatgtgcgaactcgatattttacacgactctctttaccaattctgccccgaattacacttaaaacgactcaacagcttaacgttggcttgccacgccttacttgactgtaaaactctcactcttaccgaacttggccgtaacctgccaaccaaagcgagaacaaaacataacatcaaacgaatcgaccgattgttaggtaatcgtcacctccacaaagagcgactcgctgtataccgttggcatgctagctttatctgttcgggcaatacgatgcccattgtacttgttgactggtctgatatccgtgagcaaaaacggcttatggtattgcgagcttcagtcgcactacacggtcgttctgttactctttatgagaaagcgttcccgctttcagagcaatgttcaaagaaagctcatgaccaatttctagccgaccttgcgagcattctaccgagtaacaccacaccgctcattgtcagtgatgctggctttaaagtgccatggtataaatccgttgagaagctgggttggtactggttaagtcgagtaagaggaaaagtacaatatgcagacctaggagcggaaaactggaaacctatcagcaacttacatgatatgtcatctagtcactcaaagactttaggctataagaggctgactaaaagcaatccaatctcatgccaaattctattgtataaatctcgctctaaaggccgaaaaaatcagcgctcgacacggactcattgtcaccacccgtcacctaaaatctactcagcgtcggcaaaggagccatggattctagcaactaacttacctgttgaaattcgaacacccaaacaacttgttaatatctattcgaagcgaatgcagattgaagaaaccttccgagacttgaaaagtcctgcctacggactaggcctacgccatagccgaacgagcagctcagagcgttttgatatcatgctgctaatcgccctgatgcttcaactaacatgttggcttgcgggcgttcatgctcagaaacaaggttgggacaagcacttccaggctaacacagtcagaaatcgaaacgtactctcaacagttcgcttaggcatggaagttttgcggcattctggctacacaataacaagggaagacttactcgtggctgcaaccctactagctcaaaatttattcacacatggttacgctttggggaaattatgaggggatctctcagcgttaagggattttggtcatgcattctaggtactaaaacaattcatccagtaaaatataatattttattttctcccaatcaggcttgatccccagtaagtcaaaaaatagctcgacatactgttcttccccgatatcctccctgatcgaccggacgcagaaggcaatgtcataccacttgtccgccctgccgcttctcccaagatcaataaagccacttactttgccatctttcacaaagatgttgctgtctcccaggtcgccgtgggaaaagacaagttcctcttcgggcttttccgtctttaaaaaatcatacagctcgcgcggatctttaaatggagtgtcttcttcccagttttcgcaatccacatcggccagatcgttattcagtaagtaatccaattcggctaagcggctgtctaagctattcgtatagggacaatccgatatgtcgatggagtgaaagagcctgatgcactccgcatacagctcgataatcttttcagggctttgttcatcttcatactcttccgagcaaaggacgccatcggcctcactcatgagcagattgctccagccatcatgccgttcaaagtgcaggacctttggaacaggcagctttccttccagccatagcatcatgtccttttcccgttccacatcataggtggtccctttataccggctgtccgtcatttttaaatataggttttcattttctcccaccagcttatataccttagcaggagacattccttccgtatcttttacgcagcggtatttttcgatcagttttttcaattccggtgatattctcattttagccatttattatttccttcctcttttctacagtatttaaagataccccaagaagctaattataacaagacgaactccaattcactgttccttgcattctaaaaccttaaataccagaaaacagctttttcaaagttgttttcaaagttggcgtataacatagtatcgacggagccgattttgaaaccgcggtgatcacaggcagcaacgctctgtcatcgttacaatcaacatgctaccctccgcgagatcatccgtgtttcaaacccggcagcttagttgccgttcttccgaatagcatcggtaacatgagcaaagtctgccgccttacaacggctctcccgctgacgccgtcccggactgatgggctgcctgtatcgagtggtgattttgtgccgagctgccggtcggggagctgttggct

SEQ ID NO: 17 - DNA, 15997 bp, Artificial
  JT-Binary vector pBPSMM232 [p-ZmUbi1::c-ZmAHASL/Xi12::t-ZmAHAS t-NOS::c-gusINT::p-ZmUbi1]
  misc_feature (148)..(172): complement: left T-DNA border
  promoter (298)..(2278): maize ubiquitin promoter
  misc_feature (2305)..(4305): coding for glucuronidase (GUS) gene (plus intron)
  terminator (4925)..(6140): complement: maize AHAS terminator
  misc_feature (6141)..(8057): complement: mutated maize AHAS Xi12 selection marker gene
  misc_feature (10103)..(10126): complement: right T-DNA border
  rep_origin (12489)..(13170): ColE1 origin of replication
  rep_origin (12490)..(12770): pBR322 origin of replication
cgttcttccgaatagcatcggtaacatgagcaaagtctgccgccttacaacggctctcccgctgacgccgtcccggactgatgggctgcctgtatcgagtggtgattttgtgccgagctgccggtcggggagctgttggctggctggtggcaggatatattgtggtgtaaacaaattgacgcttagacaacttaataacacattgcggacgtttttaatgtactgaattgactagtggcgcgccaagcttgcatgcctgcaggtcgactctagaggatccccatcgaattcctgcagtgcagcgtgacccggtcgtgcccctctctagagataatgagcattgcatgtctaagttataaaaaattaccacatattttttttgtcacacttgtttgaagtgcagtttatctatctttatacatatatttaaactttactctacgaataatataatctatagtactacaataatatcagtgttttagagaatcatataaatgaacagttagacatggtctaaaggacaattgagtattttgacaacaggactctacagttttatctttttagtgtgcatgtgttctcctttttttttgcaaatagcttcacctatataatacttcatccattttattagtacatccatttagggtttagggttaatggtttttatagactaatttttttagtacatctattttattctattttagcctctaaattaagaaaactaaaactctattttagtttttttatttaataatttagatataaaatagaataaaataaagtgactaaaaattaaacaaataccctttaagaaattaaaaaaactaaggaaacatttttcttgtttcgagtagataatgccagcctgttaaacgccgtcgacgagtctaacggacaccaaccagcgaaccagcagcgtcgcgtcgggccaagcgaagcagacggcacggcatctctgtcgctgcctctggacccctctcgagagttccgctccaccgttggacttgctccgctgtcggcatccagaaattgcgtggcggagcggcagacgtgagccggcacggcaggcggcctcctcctcctctcacggcaccggcagctacgggggattcctttcccaccgctccttcgctttcccttcctcgcccgccgtaataaatagacaccccctccacaccctctttccccaacctcgtgttgttcggagcgcacacacacacaaccagatctcccccaaatccacccgtcggcacctccgcttcaaggtacgccgctcgtcctccccccccccccctctctaccttctctagatcggcgttccggtccatggttagggcccggtagttctacttctgttcatgtttgtgttagatccgtgtttgtgttagatccgtgctgctagcgttcgtacacggatgcgacctgtacgtcagacacgttctgattgctaacttgccagtgtttctctttggggaatcctgggatggctctagccgttccgcagacgggatcgatttcatgattttttttgtttcgttgcatagggtttggtttgcccttttcctttatttcaatatatgccgtgcacttgtttgtcgggtcatcttttcatgcttttttttgtcttggttgtgatgatgtggtctggttgggcggtcgttctagatcggagtagaattctgtttcaaactacctggtggatttattaattttggatctgtatgtgtgtgccatacatattcatagttacgaattgaagatgatggatggaaatatcgatctaggataggtatacatgttgatgcgggttttactgatgcatatacagagatgctttttgttcgcttggttgtgatgatgtggtgtggttgggcggtcgttcattcgttctagatcggagtagaatactgtttcaaactacctggtgtatttattaattttggaactgtatgtgtgtgtcatacatcttcatagttacgagtttaagatggatggaaatatcgatctaggataggtatacatgttgatgtgggttttactgatgcatatacatgatggcatatgcagcatctattcatatgctctaaccttgagtacctatctattataataaacaagtatgttttataattattttgatcttgatatacttggatgatggcatatgcagcagctatatgtggatttttttagccctgccttcatacgctatttatttgcttggtactgtttcttttgtcgatgctcaccctgttgtttggtgttacttctgcagcccgggtaggtcagtcccttatgttacgtcctgtagaaaccccaacccgtgaaatcaaaaaactcgacggcctgtgggcattcagtctggatcgcgaaaactgtggaattggtcagcgttggtgggaaagcgcgttacaagaaagccgggcaattgctgtgccaggcagttttaacgatcagttcgccgatgcagatattcgtaattatgcgggcaacgtctggtatcagcgcgaagtctttataccgaaaggttgggcaggccagcgtatcgtgctgcgtttcgatgcggtcactcattacggcaaagtgtgggtcaataatcaggaagtgatggagcatcagggcggctatacgccatttgaagccgatgtcacgccgtatgttattgccgggaaaagtgtacgtaagtttctgcttctacctttgatatatatataataattatcattaattagtagtaatataatatttcaaatatttttttcaaaataaaagaatgtagtatatagcaattgcttttctgtagtttataagtgtgtatattttaatttataacttttctaatatatgaccaaaatttgttgatgtgcaggtatcaccgtttgtgtgaacaacgaactgaactggcagactatcccgccgggaatggtgattaccgacgaaaacggcaagaaaaagcagtcttacttccatgatttctttaactatgccggaatccatcgcagcgtaatgctctacaccacgccgaacacctgggtggacgatatcaccgtggtgacgcatgtcgcgcaagactgtaaccacgcgtctgttgactggcaggtggtggccaatggtgatgtcagcgttgaactgcgtgatgcggatcaacaggtggttgcaactggacaaggcactagcgggactttgcaagtggtgaatccgcacctctggcaaccgggtgaaggttatctctatgaactgtgcgtcacagccaaaagccagacagagtgtgatatctacccgcttcgcgtcggcatccggtcagtggcagtgaagggcgaacagttcctgattaaccacaaaccgttctactttactggctttggtcgtcatgaagatgcggacttgcgtggcaaaggattcgataacgtgctgatggtgcacgaccacgcattaatggactggattggggccaactcctaccgtacctcgcattacccttacgctgaagagatgctcgactgggcagatgaacatggcatcgtggtgattgatgaaactgctgctgtcggctttaacctctctttaggcattggtttcgaagcgggcaacaagccgaaagaactgtacagcgaagaggcagtcaacggggaaactcagcaagcgcacttacaggcgattaaagagctgatagcgcgtgacaaaaaccacccaagcgtggtgatgtggagtattgccaacgaaccggatacccgtccgcaaggtgcacgggaatatttcgcgccactggcggaagcaacgcgtaaactcgacccgacgcgtccgatcacctgcgtcaatgtaatgttctgcgacgctcacaccgataccatcagcgatctctttgatgtgctgtgcctgaaccgttattacggatggtatgtccaaagcggcgatttggaaacggcagagaaggtactggaaaaagaacttctggcctggcaggagaaactgcatcagccgattatcatcaccgaatacggcgtggatacgttagccgggctgcactcaatgtacaccgacatgtggagtgaagagtatcagtgtgcatggctggatatgtatcaccgcgtctttgatcgcgtcagcgccgtcgtcggtgaacaggtatggaatttcgccgattttgcgacctcgcaaggcatattgcgcgttggcggtaacaagaaagggatcttcactcgcgaccgcaaaccgaagtcggcggcttttctgctgcaaaaacgctggactggcatgaacttcggtgaaaaaccgcagcagggaggcaaacaatgaatcaacaactctcctggcgcaccatcgtcggctacagcctcgggaattgctaccgagctcgaatttccccgatcgttcaaacatttggcaataaagtttcttaagattgaatcctgttgccggtcttgcgatgattatcatataatttctgttgaattacgttaagcatgtaataattaacatgtaatgcatgacgttatttatgagatgggtttttatgattagagtcccgcaattatacatttaatacgcgatagaaaacaaaatatagcgcgcaaactaggataaattatcgcgcgcggtgtcatctatgttactagatcgggaattggcatgcaagcttggcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatgctagagcagcttgagcttggatcagattgtcgtttcccgccttcagtttgtgttaattaacggtccgaggcctcctcagcaagctgttaacgcgatcgcagcgccttaaggggccgctctagattagtgtacggaataaaagtcctaattcattctttttcttatacgtcaccgttttctacatttagaaaaatgaagtgggaatcaattgaaacaattgatagctttaaatatcaagctgtcttctccaggaccaggccccagcacatcggcgtggaaagcgctaggccccagaacaactcgtcaatcgtcatggcaaataatgacacattgagccgatttgatgcatggaacagactaataaggaactcaaatctctttggagattgaatgattgagatgaaaatgaattaatattttttctcaatcccctccaatgctaagaaagtttgagtttccaaattagctttagagggcgtttagatcccttcgttttagagaaattagaattcactcaataaaataacttatttaatttggaatttgatattcaaccacttttcaaagtttagatataggtctatctcaaattcatagggtggatgatggaaatgattttatgcattaatagaatttgtttctactgtgtaacttacatgacactcttcatctcactcctgtatagtaaaaatgtagcatataaatatctccgacatcttgataataatagtatacaaatatattttgcataaaaccgaattaacttaattgatatatgccaaaattactattattagaatggaatttaattccaatgatccaaaccacgaaaatggatcaggtaactaattcagtcaaatgcctcattttttttcactcccctcaaaccacgaaaatgccattctggtttgtaaaatagtttgaaattgcagccctagcattattccatacatcatatgttgagttgaaattaccaatataataataactaaaaaaggaaaaaaatagcgaaaacaaaagcaaggaccagttggacacttaaatttggcaacagaagccaattcagaaccactgcatagcagtgcttattatcttatttatatgtagcaaaaggcacttaaatgatctcttatgacacatgccagaaggaaaacaacagactacacaattacaaggtcggaagctacataggattaccataacagatagctgacggcctacaaaaaaagatagaatacaggagaacatcacacagataaaaacatatcacccttgtactagcagggaggcggtgcttgctggattttagatcagttgcttgctggattttagatcagtacacagtcctgccatcaccatccaggatcatatccttgaaagccccaccattagggatcataggcaacacatgctcctggtgtgggacgattatatccaagaggtacggccctggagtctcgagcatcttctttatcgctgcgcggacttcgttcttctttgtcacacggaccgctggaatgttgaaccctttggcgatcgtcacgaaatctggatatatctcactttcattctctgggtttcccaagtatgtgtgcgctctgttggccttatagaacctgtcctcccactgcaccaccatccccaggtgctggttgtttagcacaaagaccttcaccgggaggttctcaattcggatcatagctagctcctgaacgttcatgagaaagctaccatctccatcgatgtcaacaacagtaacacctgggttggccacagaagcaccagcagcagccggcaaaccaaatcccatagccccaagaccagctgaagacaaccactgccttggccgcttgtaagtgtagtactgtgccgcccacatctggtgctgcccaacacctgtgccgatgatggcctcgcctttcgtcagctcatcaagaacctgaatagcatattgtggctggatctcctcattagatgttttatacccaagggggaattccctcttctgctgatccaactcatcgttccatgagccaaagtcaaagctcttctttgatgtgcttccttcaagaagagcattcatgccctgcaaagcaagcttaacatctgcacagatggacacatgtggctgcttgttcttgccaatctcagccggatcaatatcaacgtgcacaatcttagccctgcttgcaaaagcctcaatcttccctgtcacacgatcatcaaaccgcacaccaagtgcaagcaacagatcggccttatccactgcataatttgcatacaccgtgccatgcatacctagcatgcgcagagacagtgggtcgtcgctggggaagttgccgaggcccataagagtagttgtgaccgggattccagtcagctccacaaagcgtcgcaactcctcaccagatgctgcgcagccaccgccaacataaagaacagggcgccgggattcaccaacaagacgcagcacctgctcaagcaactcagtcgcagggggcttgggaaggcgcgcaatgtacccaggcagactcatgggcttgtcccagacaggcaccgccatctgctgctggatgtccttggggatgtcgacaagcaccggccccggtcgaccagaggaggcgaggaagaaagcctcctgcacgacgcgggggatgtcgtcgacgtcgaggaccaggtagttgtgcttggtgatggagcgggtgacctcgacgatgggcgtctcctggaaggcgtcggtgccaatcatgcgtcgcggcacctgtcccgtgatggcgaccatggggacggaatcgagcagcgcgtcggcgagcgcggagacaaggttggtggcgccggggccggaggtggcgatgcagacgccgacgcggcccgaggagcgcgcgtagccggaggccgcaaaggcctccccttgctcgtggcggaagaggtggttggcgatgacgggggagcgggtgagtgcctggtggatctccatggacgcgccgccggggtaggcgaagacgtcgcggacgccgcagcgctcgagggactcgacgaggatgtcggcgcccttgcggggatcggtggggccccacggccggagcggggtggccgggggagccatcggcatggcgggtgacgccgctgagcacctgatgggcgcggcgagggcgcggcgggtggccaggaggtgcgcccggcgcctcgccttgggcgcagcggtagtggcgccagtgagcgcggtagacgcggcggcggcggtggccatggtttctagaactagtggatcccccgggctgcagaagtaacaccaaacaacagggtgagcatcgacaaaagaaacagtaccaagcaaataaatagcgtatgaaggcagggctaaaaaaatccacatatagctgctgcatatgccatcatccaagtatatcaagatcaaaataattataaaacatacttgtttattataatagataggtactcaaggttagagcatatgaatagatgctgcatatgccatcatgtatatgcatcagtaaaacccacatcaacatgtatacctatcctagatcgatatttccatccatcttaaactcgtaactatgaagatgtatgacacacacatacagttccaaaattaataaatacaccaggtagtttgaaacagtattctactccgatctagaacgaatgaacgaccgcccaaccacaccacatcatcacaaccaagcgaacaaaaagcatctctgtatatgcatcagtaaaacccgcatcaacatgtatacctatcctagatcgatatttccatccatcatcttcaattcgtaactatgaatatgtatggcacacacatacagatccaaaattaataaatccaccaggtagtttgaaacagaattctactccgatctagaacgaccgcccaaccagaccacatcatcacaaccaagacaaaaaaaagcatgaaaagatgacccgacaaacaagtgcacggcatatattgaaataaaggaaaagggcaaaccaaaccctatgcaacgaaacaaaaaaaatcatgaaatcgatcccgtctgcggaacggctagagccatcccaggattccccaaagagaaacactggcaagttagcaatcagaacgtgtctgacgtacaggtcgcatccgtgtacgaacgctagcagcacggatctaacacaaacacggatctaacacaaacatgaacagaagtagaactaccgggccctaaccatggaccggaacgccgatctagagaaggtagagagggggggggggggaggacgagcggcgtaccttgaagcggaggtgccgacgggtggatttgggggagatctggttgtgtgtgtgtgcgctccgaacaacacgaggttggggaaagagggtgtggagggggtgtctatttattacggcgggcgaggaagggaaagcgaaggagcggtgggaaaggaatcccccgtagctgccggtgccgtgagaggaggaggaggccgcctgccgtgccggctcacgtctgccgctccgccacgcaatttctggatgccgacagcggagcaagtccaacggtggagcggaactctcgagaggggtccagaggcagcgacagagatgccgtgccgtctgcttcgcttggcccgacgcgacgctgctggttcgctggttggtgtccgttagactcgtcgacggcgtttaacaggctggcattatctactcgaaacaagaaaaatgtttccttagtttttttaatttcttaaagggtatttgtttaatttttagtcactttattttattctattttatatctaaattattaaataaaaaaactaaaatagagttttagttttcttaatttagaggctaaaatagaataaaatagatgtactaaaaaaattagtctataaaaaccattaaccctaaaccctaaatggatgtactaataaaatggatgaagtattatataggtgaagctatttgcaaaaaaaaaggagaacacatgcacactaaaaagataaaactgtagagtcctgttgtcaaaatactcaattgtcctttagaccatgtctaactgttcatttatatgattctctaaaacactgatattattgtagtactatagattatattattcgtagagtaaagtttaaatatatgtataaagatagataaactgcacttcaaacaagtgtgacaaaaaaaatatgtggtaattttttataacttagacatgcaatgctcattatctctagagaggggcacgaccgggtcacgctgcactgcaggaattcgataaactatcagtgtttgacaggatatattggcgggtaaacctaagagaaaagagcgtttattagaataatcggatatttaaaagggcgtgaaaaggtttatccgttcgtccatttgtatgtgcatgccaaccacagggttcccctcgggagtgcttggcattccgtgcgataatgacttctgttcaaccacccaaacgtcggaaagcctgacgacggagcagcattccaaaaagatcccttggctcgtctgggtcggctagaaggtcgagtgggctgctgtggcttgatccctcaacgcggtcgcggacgtagcgcagcgccgaaaaatcctcgatcgcaaatccgacgctgtcgaaaagcgtgatctgcttgtcgctctttcggccgacgtcctggccagtcatcacgcgccaaagttccgtcacaggatgatctggcgcgagttgctggatctcgccttcaatccgggtctgtggcgggaactccacgaaaatatccgaacgcagcaagatcgtcgaccaattcttgaagacgaaagggcctcgtgatacgcctatttttataggttaatgtcatgataataatggtttcttagacgtcaggtggcacttttcggggaaatgtgcgcggaacccctatttgtttatttttctaaatacattcaaatatgtatccgctcatgagacaataaccctgataaatgcttcaataatattgaaaaaggaagagtatgagtattcaacatttccgtgtcgcccttattcccttttttgcggcattttgccttcctgtttttgctcacccagaaacgctggtgaaagtaaaagatgctgaagatcagttgggtgcacgagtgggttacatcgaactggatctcaacagcggtaagatccttgagagttttcgccccgaagaacgttttccaatgatgagcacttttaaagttctgctatgtggcgcggtattatcccgtgttgacgccgggcaagagcaactcggtcgccgcatacactattctcagaatgacttggttgagtactcaccagtcacagaaaagcatcttacggatggcatgacagtaagagaattatgcagtgctgccataaccatgagtgataacactgcggccaacttacttctgacaacgatcggaggaccgaaggagctaaccgcttttttgcacaacatgggggatcatgtaactcgccttgatcgttgggaaccggagctgaatgaagccataccaaacgacgagcgtgacaccacgatgcctgcagggggggggggggggggacatgaggttgccccgtattcagtgtcgctgatttgtattgtctgaagttgtttttacgttaagttgatgcagatcaattaatacgatacctgcgtcataattgattatttgacgtggtttgatggcctccacgcacgttgtgatatgtagatgataatcattatcactttacgggtcctttccggtgatccgacaggttacggggcggcgacctcgcgggttttcgctatttatgaaaattttccggtttaaggcgtttccgttcttcttcgtcataacttaatgtttttatttaaaataccctctgaaaagaaaggaaacgacaggtgctgaaagcgagctttttggcctctgtcgtttcctttctctgtttttgtccgtggaatgaacaatggaacccccccccccccccccctgcagcaatggcaacaacgttgcgcaaactattaactggcgaactacttactctagcttcccggcaacaattaatagactggatggaggcggataaagttgcaggaccacttctgcgctcggcccttccggctggctggtttattgctgataaatctggagccggtgagcgtgggtctcgcggtatcattgcagcactggggccagatggtaagccctcccgtatcgtagttatctacacgacggggagtcaggcaactatggatgaacgaaatagacagatcgctgagataggtgcctcactgattaagcattggtaactgtcagaccaagtttactcatatatactttagattgatttaaaacttcatttttaatttaaaaggatctaggtgaagatcctttttgataatctcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgtccttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgttctttcctgcgttatcccctgattctgtggataaccgtattaccgcctttgagtgagctgataccgctcgccgcagccgaacgaccgagcgcagcgagtcagtgagcgaggaagcggaagagcgcctgatgcggtattttctccttacgcatctgtgcggtatttcacaccgcatatggtgcactctcagtacaatctgctctgatgccgcatagttaagccagtatacactccgctatcgctacgtgactgggtcatggctgcgccccgacacccgccaacacccgctgacgcgccctgacgggcttgtctgctcccggcatccgcttacagacaagctgtgaccgtctccgggagctgcatgtgtcagaggttttcaccgtcatcaccgaaacgcgcgaggcagcagatcccccgatcaagtagatacactacatatatctacaatagacatcgagccggaaggtgatgtttactttcctgaaatccccagcaattttaggccagtttttacccaagacttcgcctctaacataaattatagttaccaaatctggcaaaagggttaacaagtggcagcaacggattcgcaaacctgtcacgccttttgtgccaaaagccgcgccaggtttgcgatccgctgtgccaggcgttaggcgtcatatgaagatttcggtgatccctgagcaggtggcggaaacattggatgctgagaaccatttcattgttcgtgaagtgttcgatgtgcacctatccgaccaaggctttgaactatctaccagaagtgtgagcccctaccggaaggattacatctcggatgatgactctgatgaagactctgcttgctatggcgcattcatcgaccaagagcttgtcgggaagattgaactcaactcaacatggaacgatctagcctctatcgaacacattgttgtgtcgcacacgcaccgaggcaaaggagtcgcgcacagtctcatcgaatttgcgaaaaagtgggcactaagcagacagctccttggcatacgattagagacacaaacgaacaatgtacctgcctgcaatttgtacgcaaaatgtggctttactctcggcggcattgacctgttcacgtataaaactagacctcaagtctcgaacgaaacagcgatgtactggtactggttctcgggagcacaggatgacgcctaacaattcattcaagccgacaccgcttcgcggcgcggcttaattcaggagttaaacatcatgagggaagcggtgatcgccgaagtatcgactcaactatcagaggtagttggcgtcatcgagcgccatctcgaaccgacgttgctggccgtacatttgtacggctccgcagtggatggcggcctgaagccacacagtgatattgatttgctggttacggtgaccgtaaggcttgatgaaacaacgcggcgagctttgatcaacgaccttttggaaacttcggcttcccctggagagagcgagattctccgcgctgtagaagtcaccattgttgtgcacgacgacatcattccgtggcgttatccagctaagcgcgaactgcaatttggagaatggcagcgcaatgacattcttgcaggtatcttcgagccagccacgatcgacattgatctggctatcttgctgacaaaagcaagagaacatagcgttgccttggtaggtccagcggcggaggaactctttgatccggttcctgaacaggatctatttgaggcgctaaatgaaaccttaacgctatggaactcgccgcccgactgggctggcgatgagcgaaatgtagtgcttacgttgtcccgcatttggtacagcgcagtaaccggcaaaatcgcgccgaaggatgtcgctgccgactgggcaatggagcgcctgccggcccagtatcagcccgtcatacttgaagctaggcaggcttatcttggacaagaagatcgcttggcctcgcgcgcagatcagttggaagaatttgttcactacgtgaaaggcgagatcaccaaggtagtcggcaaataatgtctaacaattcgttcaagccgacgccgcttcgcggcgcggcttaactcaagcgttagagagctggggaagactatgcgcgatctgttgaaggtggttctaagcctcgtacttgcgatggcatcggggcaggcacttgctgacctgccaattgttttagtggatgaagctcgtcttccctatgactactccccatccaactacgacatttctccaagcaactacgacaactccataagcaattacgacaatagtccatcaaattacgacaactctgagagcaactacgataatagttcatccaattacgacaatagtcgcaacggaaatcgtaggcttatatatagcgcaaatgggtctcgcactttcgccggctactacgtcattgccaacaatgggacaacgaacttcttttccacatctggcaaaaggatgttctacaccccaaaaggggggcgcggcgtctatggcggcaaagatgggagcttctgcggggcattggtcgtcataaatggccaattttcgcttgccctgacagataacggcctgaagatcatgtatctaagcaactagcctgctctctaataaaatgttaggcctcaacatctagtcgcaagctgaggggaaccactagtgtcatacgaacctccaagagacggttacacaaacgggtacattgttgatgtcatgtatgacaatcgcccaagtaagtatccagctgtgttcagaacgtacgtccgaattaattcatcggggtacggtcgacgatcgtcaacgttcacttctaaagaaatagcgccactcagcttcctcagcggctttatccagcgatttcctattatgtcggcatagttctcaagatcgacagcctgtcacggttaagcgagaaatgaataagaaggctgataattcggatctctgcgagggagatgatatttgatcacaggcagcaacgctctgtcatcgttacaatcaacatgctaccctccgcgagatcatccgtgtttcaaacccggcagcttagttgc

SEQ ID NO: 18 - DNA, 24 bp, Agrobacterium strain K599 (NCPPB 2659)
tggcaggatatattgtggtgtaaa

SEQ ID NO: 19 - DNA, 24 bp, Agrobacterium strain K599 (NCPPB 2659)
tgacaggatatatccccttgtcta

SEQ ID NO: 20 - DNA, 1181 bp, Agrobacterium strain K599 (NCPPB 2659)
  misc_feature (1)..(1181): 16S-23S intergenic sequence
aatgagggtttgggttgagactaatcgtcgatgcgaattgttgccgcgcctggttgatgagacctgggtgatcgagctggatggggctgtagctcagctgggagagcacctgctttgcaagcagggggtcagcggttcgatcccgctcagctccaccatttgttttgtcctgacgctgtcgcgatctaacgatcgctgcgctccggacgggccgcgccacgaggcgcgacggactatcgtcctttatgggcgaattgatctgacggctgcgaattgtcttctgaagaaataaaagtttgcatcgtcctgctaaggattgatgcctgttctgaatacattgtgaagagaagatatgtctggaagcgtccaggtgttttgggtttaggcccgagacgtccgagaccagtccttgtgaaaccgtgtgatggcttagtcggccggaattggtggaggggttggaggtaggaaggatcgcttgtcctgggcatttttgttgttggaacttcggttcctctgatgaagatgctggattggtgttgcctgaccgcgcatcaccggatgatatctcgagaagctggtcttaatggtatggcttcgaggtgcaccggcgtgccctcaaagaagaccgtaccgacacgtcgatgtcatcgttggtgttgcggttgtaaaaggtaaccgtaaccgttgttcctctctttatcgttagggatggaatggctttcgcggcagattgagttttgcccggatggcccgatttggcacccctttgagcgcaagcgagaaggaaaggttctgccaaatccaacagatgatgagcatagacaatgagaacgaagaagtgaattaagggcatttggtggatgccttggcatgcacaggcgaagaaggacgtgatacgctgcgaaaagccgtggggagctgcgaataagctttgatccatggatctccgaatggggcaacccaccttaaatgcttggaaaatccagtctgttttaacgaacggcctgggtttccaagcattgtgataaggtatcttactttcgaatacataggggtaagaagcgaacgcagggaactgaaacatctaagtacctgcaggaaaggacatcaaccgagactccgcaagtagtggcgagcgaacgcggaccaggccagtggcaatgatgaataaagcggaacga

SEQ ID NO: 21 - DNA, 1480 bp, Agrobacterium strain K599 (NCPPB 2659)
tggagagtttgatcctggctcagaacgaacgctggcggcaggcttaacacatgcaagtcgaacgccccgcaaggggagtggcagacgggtgagtaacgcgtgggaacataccctttcctgcggaatagctccgggaaactggaattaataccgcatacgccctacgggggaaagatttatcggggaaggattggcccgcgttggattagctagttggtggggtaaaggcctaccaaggcgacgatccatagctggtctgagaggatgatcagccacattgggactgagacacggcccaaactcctacgggaggcagcagtggggaatattggacaatgggcgcaagcctgatccagccatgccgcgtgagtgatgaaggccttagggttgtaaagctctttcaccggagaagataatgacggtatccggagaagaagccccggctaacttcgtgccagcagccgcggtaatacgaagggggctagcgttgttcggaattactgggcgtaaagcgcacgtaggcggatatttaagtcaggggtgaaatcccagagctcaactctggaactgcctttgatactgggtatcttgagtatggaagaggtaagtggaattccgagtgtagaggtgaaattcgtagatattcggaggaacaccagtggcgaaggcggcttactggtccattactgacgctgaggtgcgaaagcgtggggagcaaacaggattagataccctggtagtccacgccgtaaacgatgaatgttagccgtcgggcagtatactgttcggtggcgcagctaacgcattaaacattccgcctggggagtacggtcgcaagattaaaactcaaaggaattgacgggggcccgcacaagcggtggagcatgtggtttaattcgaagcaacgcgcagaaccttaccagctcttgacattcggggtatgggcattggagacgatgtccttcagttaggctggccccagaacaggtgctgcatggctgtcgtcagctcgtgtcgtgagatgttgggttaagtcccgcaacgagcgcaaccctcgcccttagttgccagcattcagttgggcactctaaggggactgccggtgataagccgagaggaaggtggggatgacgtcaagtcctcatggcccttacgggctgggctacacacgtgctacaatggtggtgacagtgggcagcgagacagcgatgtcgagctaatctccaaaagccatctcagttcggattgcactctgcaactcgagtgcatgaagttggaatcgctagtaatcgcagatcagcatgctgcggtgaatacgttcccgggccttgtacacaccgcccgtcacaccatgggagttggttttacccgaaggtagtgcgctaaccgcaaggaggcagctaaccacggtagggtcagcgactggggtgaagtcgtaacaaggtagccgtaggggaacctgcggctggatcacctcctt

SEQ ID NO: 22 - DNA, 11715 bp, Artificial
  Deletion vector pBPSSH009
  misc_feature (189)..(2334): left T-DNA flank of pRI2659
  misc_feature (2291)..(3481): tetracycline resistance gene
  promoter (2436)..(2442): tetracyclin resistance gene promoter
  misc_feature (3827)..(5906): right T-DNA flank of pRI2659
  rep_origin (6624)..(7749): pMB1 replication origin including oriV and oriT
  misc_feature (8222)..(9643): complement: CDS for sacB from B. subtilis
  misc_feature (10498)..(11292): nptII conding sequence for kanamycin resistance
aaatagctttggattggaggagtatggccactaatactaagttcagctaataaaaaaatttgctaaagaactccagctggatttcactgatgagaatatcgtcggagataaatataataattccacggactatagactatactagtttaattaagtctagagtcgactgtttaaacctgcaggcatgccacgacaatcgctgtccttacaaactatgctgcccgacgcgatgcacaccttggcacgccgcgcagtccctatttcttcgtcgccgaacagggcggcagattgctgcatcaatacgtgcaccgggtgttctggcgactatcccggcaaattggtttacggcaggagggggatcgcggtggcccgcgggttcacgatcttcgtcaccgtttcgccgtccaaaccctgatcaactggcatcgcgctggcgaagatgtggaacgcgagctgccggtactctcgaccttcctcggccatgccaatgttcgcgacacctactggtatctgtccgccgcgccggagctgatgaatcatgccgttcggcgattggataagcggtgggaggttcggtcatgagacgaacgaacgacttagccgtgctgatcgagcggtggttcacagatcggctcatgaagcatcgaggtgtaagttccaacaccattgcctcctatcgagacacgttcaggctcctgtttgcgttcgcgcaggcgcgccttgggaggtccccatctcaattgacactgcgggatttggacgctccgttcatcggcgcattcctggaagtcctcgagacgcagagagccgcctcggtgaggacccggaatctccgcctcacagccattcgatctttcttccgatatgcggcgttcgaggagccggcacatagcgcccacatccagcgcgtgctcgcgatccccagcaagcgatgcgacaagcggcagcttcagttcctaaccaggcccgagattgaatcgatcctggactgcacggatcgaagcacgtggctgggacgccgcgattacactctgctattgctggccgcgcaaacggggctgcgggtttcggaagtcatcgacctcgaccgagactcggtaatgctcggccgcggtgcgcatgtgcaatgcgtcggtaagggccgcaaagagcgaagtacgccgctcacaaaggttgcacaggaagccctccggcgttggctcaaggaaccagggaagcgaggcgcaacggctctctttccgaatatgcacggtggcaggctcagcgccgacggcgtgcaggcactgctgaacaaatatgtcgccaaagcgcgcgagcactgcgtctccctccgctcgaagcgggtgtcgccccacgtcttgcggcacagcgctgccatggagctactacaggcgggcgtcgactgctcggtcattgccctgtggctgggccatgaggcgatggaaacgacgctgacctatcttcatgcacatcttgaactgaaggaatcgacactcgcaaagctgaagccgtacgaacgcgccaaggccgagcgatttcgaccaaacgaccggcttctggaattcctgaacgccctctgagcatgagaactatgccgagtgccaacgacgggtcttcgaccaaaacggcaagagaagcgcgtttcaactggtaagttggaagaggtgctcggcatagttcgccggtcggcataaaccgccttatgccgcgcgcggcataatgctgtcatgatcagtgtcgccatgaaggcggcgcgatcggcacctcgatccgatccggcgaagagccatgacttcctcccgagagcaaagcctctcagcgctcgttcggccgcgttgttcgtgagacaaatcctgccctcgtcgaggaaagacgtgaagccgttccagcgcttcagcatgtagtcgatcggctcggcgactggagaactgcgcgacagttttgcccgttcggtttgaagccagcagtgcagttcgccgacaagcggcaggctgtccttgcgacggcgctccaggcgttccgctgcggcaagcccgttgatctgccgctcgatgtcgaacagggcatcgatccgtttgacggcctccaacgccataggcgagatcggtgcggcgcggctgccgcgtttggcattcgtggcgatgtcggccagcacgaagaacttgcgcctcgcgtgcgaccagcagagcgcctgcgtcagcggccccggatcgcgggtctaccttgaacagcggattgtagccgccaatatgttctgccgaacatatcgggggctatgttgcggccgtccatatgtggccctgctgacctataccctttgtcaactgagtatttgggcccggatctatcgatgcatgccatggtacccgggagctcgaattcgcgtcaattctcatgtttgacagcttatcatcgataagctagctttaatgcggtagtttatcacagttaaattgctaacgcagtcaggcaccgtgtatgaaatctaacaatgcgctcatcgtcatcctcggcaccgtcaccctggatgctgtaggcataggcttggttatgccggtactgccgggcctcttgcgggatatcgtccattccgacagcatcgccagtcactatggcgtgctgctagcgctatatgcgttgatgcaatttctatgcgcacccgttctcggagcactgtccgaccgctttggccgccgcccagtcctgctcgcttcgctacttggagccactatcgactacgcgatcatggcgaccacacccgtcctgtggattctctacgccggacgcatcgtggccggcatcaccggcgccacaggtgcggttgctggcgcctatatcgccgacatcaccgatggggaagatcgggctcgccacttcgggctcatgagcgcttgtttcggcgtgggtatggtggcaggccccgtggccgggggactgttgggcgccatctccttacatgcaccattccttgcggcggcggtgctcaacggcctcaacctactactgggctgcttcctaatgcaggagtcgcataagggagagcgccgaccgatgcccttgagagccttcaacccagtcagctccttccggtgggcgcggggcatgactatcgtcgccgcacttatgactgtcttgtttatcatgcaactcgtaggacaggtgccggcagcgctctgggtcattttcggcgaggaccgctttcgctggagcgcgacgatgatcggcctgtcgcttgcggtattcggaatcttgcacgccctcgctcaagccttcgtcactggtcccgccaccaaacgtttcggcgagaagcaggccattatcgccggcatggcggccgacgcgctgggctacgtcttgctggcgttcgcgacgcgaggctggatggccttccccattatgattcttctcgcttccggcggcatcgggatgcccgcgttgcaggccatgctgtccaggcaggtagatgacgaccatcagggacagcttcaaggatcgctcgcggctcttaccagcctaacttcgatcactggaccgctgatcgtcacggcgatttatgccgcctcggcgagcacatggaacgggttggcatggattgtaggcgccgccctataccttgtctgcctccccgcgttgcgtcgcggtgcatggagccgggccacctcgacctgaatggaagccggcggcacctcgctaacggattcaccactccaagaattggagccaatcaattcttgcggagaactgtgaatgcgcaaaccaacccttgatcaagctgacgcgaattcgaagcttctgcagacgcgtcgacgtcatatggatccaattcctttaagctctcgatgccccggtcggtgaaggtcgtgacgccctcttggctgccgtcatgggcatggatcatctcgccgtaatcgatattgtctgagttgctggcgatttcctggaggagttcgaggttctcgccgatcagcgaagcaacataatcgatcgtgtagacatgcgtcgggcgcgctgaccttgccccgttgtgagccgctaagcgcattgtcctcaccaccagctcatgtgctgtaacgcgcgaagctgtcgcaggctgtaccctctataagttaaggtacaactctgccgttggatgaattagcctcctgaaacgcttcctttacgtggctgatcaaagcacgttcagtctcgttaagcggcgtggaggtggagaatattgcccatagtcgccgcggcgggactaaatggtcgagagagaacgtgtccacgatccctgcctcgatctccttgatcatcaccgacgctggcaagatcgtgccaagaggtgaacgacgcaaaaccgagacgatcagaggtaccgaacccaaccgcattaccggctcgagctgcacagtagacttcgcaagtgccgtcagaagagtttgatgcattgtgagctgtgaaggtgccagaaggagcgggatgctcctcagctcgtctgccgaaactctctcggcctgaggcgcaaaattcagcttcctattgacgatcaggacgacgtcttcgctgcggccaattagtagagagcctacttgcggatcgatcctaccaacgacagcaatattgaaacggccggttagaacgccatgatgcagtacatgtcgagggccctccacaacctcgatttggcagttcggaaaattcattgtgaaatgcgctaagcgccacggccatgcattcggacgtcaaggaatctgcgctccaactcaccggtaacgcaatccgaattgattgttcaaaggccgcagctatgtggcttcgttcgcccagagtgtcgttgaaagccctctcaacgccgacaaacagcgaatgcagcctttcagcatcatcggtcggttcagaaccggtcttcttccggtcgataagccttgtcccgagcgcatattcgatctgttcaagctgggccggtatcatcggagcagtccgtccggcgacgcgggcagcgctcgccatgctgccggtctgcaccacacgattcacggtagaaatctgcttcaggctaaccttgggatggaaattcgtggcttcggaccagcccgaaggggcctcgacgcctttgcggacatcatttagcagatttaacagaagttcatggtcgttagagagctctgcggtcacgcagcacgacggactgcgaattaccggaaccgcagtgatgccctggatgcgaagacgctggggtacagtcagttggggcagaagtagatccgacttgcggatgtcgtcgatgagccctcggagatcctgcagacttcgatcggtggtggaaatccgtgatgtcgcgataccgctggagcggtcgaatttcgtgtcgctttgcagtgtacccggcagatcgggaatttcggtttttggagcaatgtcaccacgctcgggtcgctccccaaccgtatgggtcagcctcgtccaatggtctggagcaacgacaacagaaggtccggataccccagtaccgatggtatgttggatcttgagctgcccgagtggcaccgcgtctgacagaagatggctgggaccgttctgcattccgaaggcgccagtacccgtgaagatcaagtctacataagggtggtcgggtttggaatggaagcggcggatcgccgtgattacagcgtaggaaattgctgtccaggtatagtcaacgtctaatttgaggatgacgggcgccgaaggcgccgcgctgccgccaagtttggcatgactcaaatattcctcggcaaggaggagacgaacactgcgattgtacagccagaccgccgagcgtagcggaaaggagttacgccctttgcgaccaaaaagcgtcactccaatctgggcttcgagcgtgctgagcttggcatctcaatgccgatggtgtgagaccaagcttcgcggccgcactagtatactccgtctactgtacgatacacttccgctcaggtccttgtcctttaacgaggattgttacgtacgctaatggcgtcaaaacaaagactctagacctaggccttaagatcgaaagagctggtagttggcgcactgttcgaagaactgccgatgtccagtaagattcttactatgctggttgaaccggatgctggtaaagctacttgggttgctgcttctacttatggtaccgatacaactactggtgaggaagttaaaggagctcgcgaaagcttgcatgcctgcagcaatggcaacaacgttgcgcaaactattaactggcgaactacttactctagcttcccggcaacaattaatagactggatggaggcggataaagttgcaggaccacttctgcgctcggcccttccggctggctggtttattgctgataaatctggagccggtgagcgtgggtctcgcggtatcattgcagcactggggccagatggtaagccctcccgtatcgtagttatctacacgacggggagtcaggcaactatggatgaacgaaatagacagatcgctgagataggtgcctcactgattaagcattggtaactgtcagaccaagtttactcatatatactttagattgatttaaaacttcatttttaatttaaaaggatctaggtgaagatcctttttgataatctcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgtccttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagcattgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgttctttcctgcgttatcccctgattctgtggataaccgtattaccgcctttgagtgagctgataccgctcgccgcagccgaacgaccgagcgcagcgagtcagtgagcgaggaagcggaagagcgcctgatgcggtattttctccttacgcatctgtgcggtatttcacaccgcatatggtgcactctcagtacaatctgctctgatgccgcatagttaagccagtatacactccgctatcgctacgtgactgggtcatggctgcgccccgacacccgccaacacccgctgacgcgccctgacgggcttgtctgctcccggcatccgcttacagacaagctgtgaccgtctccgggagctgcatgtgtcagaggttttcaccgtcatcaccgaaacgcgcgaggcaggctggctgttttacgcgtatgacaggctccggaagacggttgttgcgcacgtattcggtgaacgcactatggcgacgctggggcgtcttatgagcctgctgtcaccctttgacgtggtgatatggatgacggatggctggccgctgtatgaatcccgcctgaagggaaagctgcacgtaatcagcaagcgatatacgcagcgaattgagcggcataacctgaatctgaggcagcacctggcacggctgggacggaagtcgctgtcgttctcaaaatcggtggagctgcatgacaaagtcatcgggcattatctgaacataaaacactatcaataagttggagtcattaccaaaaggttaggaatacggttagccatttgcctgcttttatatagttcatatgggattcacctttatgttgataagaaataaaagaaaatgccaataggatatcggcattttcttttgcgtttttatttgttaactgttaattgtccttgttcaaggatgctgtctttgacaacagatgttttcttgcctttgatgttcagcaggaagcttggcgcaaacgttgattgtttgtctgcgtagaatcctctgtttgtcatatagcttgtaatcacgacattgtttcctttcgcttgaggtacagcgaagtgtgagtaagtaaaggttacatcgttaggatcaagatccatttttaacacaaggccagttttgttcagcggcttgtatgggccagttaaagaattagaaacataaccaagcatgtaaatatcgttagacgtaatgccgtcaatcgtcatttttgatccgcgggagtcagtgaacaggtaccatttgccgttcattttaaagacgttcgcgcgttcaatttcatctgttactgtgttagatgcaatcagcggtttcatcacttttttcagtgtgtaatcatcgtttagctcaatcataccgagagcgccgtttgctaactcagccgtgcgttttttatcgctttgcagaagtttttgactttcttgacggaagaatgatgtgcttttgccatagtatgctttgttaaataaagattcttcgccttggtagccatcttcagttccagtgtttgcttcaaatactaagtatttgtggcctttatcttctacgtagtgaggatctctcagcgtatggttgtcgcctgagctgtagttgccttcatcgatgaactgctgtacattttgatacgtttttccgtcaccgtcaaagattgatttataatcctctacaccgttgatgttcaaagagctgtctgatgctgatacgttaacttgtgcagttgtcagtgtttgtttgccgtaatgtttaccggagaaatcagtgtagaataaacggatttttccgtcagatgtaaatgtggctgaacctgaccattcttgtgtttggtcttttaggatagaatcatttgcatcgaatttgtcgctgtctttaaagacgcggccagcgtttttccagctgtcaatagaagtttcgccgactttttgatagaacatgtaaatcgatgtgtcatccgcatttttaggatctccggctaatgcaaagacgatgtggtagccgtgatagtttgcgacagtgccgtcagcgttttgtaatggccagctgtcccaaacctccaggccttttgcagaagagatatttttaattgtggacgaatcgaattcaggaacttgatatttttcatttttttgctgttcagggatttgcagcatatcatggcgtgtaatatgggaaatgccgtatgtttccttatatggcttttggttcgtttctttcgcaaacgcttgagttgcgcctcctgccagcagtgcggtagtaaaggttaatactgttgcttgttttgcaaactttttgatgttcatcgttcatgtctccttttttatgtactgtgttagcggtctgcttcttccagccctcctgtttgaagatggcaagttagttacgcacaataaaaaaagacctaaaatatgtaaggggtgacgccaaagtatacactttgccctttacacattttaggtcttgcctgctttatcagtaacaaacccgcgcgatttacttttcgacctcattctattagactctcgtttggattgcaactggtctattttcctcttttgtttgatagaaaatcataaaaggatttgcagactacgggcctaaagaactaaaaaatctatctgtttcttttcattctctgtattttttatagtttctgttgcatgggcataaagttgcctttttaatcacaattcagaaaatatcataatatctcatttcactaaataatagtgaacggcaggtatatgtgatgggttaaaaaggatcgatcctctagctagagtcgacctgcatcccttaacttacttattaaataatttatagctattgaaaagagataagaattgttcaaagctaatattgtttaaatcgtcaattcctgcatgttttaaggaattgttaaattgattttttgtaaatattttcttgtattctttgttaacccatttcataacgaaataattatacttttgtttatctttgtgtgatattcttgatttttttctacttaatctgataagtgagctattcactttaggtttaggatgaaaactagaggatctcaatgaatattggttgacacgggcgtataagacatgttatactgttgaataacaaggacggatctgatcaagagacaggatgaggatcgtttcgcatgattgaacaagatggattgcacgcaggttctccggccgcttgggtggagaggctattcggctatgactgggcacaacagacaatcggctgctctgatgccgccgtgttccggctgtcagcgcaggggcgcccggttctttttgtcaagaccgacctgtccggtgccctgaatgaactgcaggacgaggcagcgcggctatcgtggctggccacgacgggcgttccttgcgcagctgtgctcgacgttgtcactgaagcgggaagggactggctgctattgggcgaagtgccggggcaggatctcctgtcatctcaccttgctcctgccgagaaagtatccatcatggctgatgcaatgcggcggctgcatacgcttgatccggctacctgcccattcgaccaccaagcgaaacatcgcatcgagcgagcacgtactcggatggaagccggtcttgtcgatcaggatgatctggacgaagagcatcaggggctcgcgccagccgaactgttcgccaggctcaaggcgcgcatgcccgacggcgaggatctcgtcgtgacccatggcgatgcctgcttgccgaatatcatggtggaaaatggccgcttttctggattcatcgactgtggccggctgggtgtggcggaccgctatcaggacatagcgttggctacccgtgatattgctgaagagcttggcggcgaatgggctgaccgcttcctcgtgctttacggtatcgccgctcccgattcgcagcgcatcgccttctatcgccttcttgacgagttcttctgagcgggactctggggttcgaaatgaccgaccaagcgacgcccaacctgccatcacgagatttcgattccaccgccgccttctatgaaaggttgggcttcggaatcgttttccgggacgccggctggatgatcctccagcgcggggatctcatgctggagttcttcgcccaccggggatcctctagactgcgatgagtggcagggcggggcgtaatttttttaaggcagttattggtgcccttaaacgcctggtgctacgcctgaataagtgataataagcggatgaatggcagaaattcgatatctagatctcgagctggatacttcccgtccgccagggggacatgccggcgatgctgaaggtcgcgcgcattcccgatgaagaggccggttaccgcctgtttgaggatatagtaatctttct

SEQ ID NO: 23 - DNA, 10240 bp, Artificial
  Deletion vector pRL278/LF, also known as pBPSSH009b
  rep_origin (716)..(1841): ColE1
  misc_feature (2314)..(3735): CDS for sacB from B. subtilis, complement
  misc_feature (4590)..(5384): kanamycin and neomycin resistance CDS nptII
  misc_feature (5996)..(8141): left T-DNA flank of pRI2659
  misc_feature (8159)..(10238): right T-DNA flank of pRI2659
ggccgcactagtatactccgtctactgtacgatacacttccgctcaggtccttgtcctttaacgaggattgttacgtacgctaatggcgtcaaaacaaagactctagacctaggccttaagatcgaaagagctggtagttggcgcactgttcgaagaactgccgatgtccagtaagattcttactatgctggttgaaccggatgctggtaaagctacttgggttgctgcttctacttatggtaccgatacaactactggtgaggaagttaaaggagctcgcgaaagcttgcatgcctgcagcaatggcaacaacgttgcgcaaactattaactggcgaactacttactctagcttcccggcaacaattaatagactggatggaggcggataaagttgcaggaccacttctgcgctcggcccttccggctggctggtttattgctgataaatctggagccggtgagcgtgggtctcgcggtatcattgcagcactggggccagatggtaagccctcccgtatcgtagttatctacacgacggggagtcaggcaactatggatgaacgaaatagacagatcgctgagataggtgcctcactgattaagcattggtaactgtcagaccaagtttactcatatatactttagattgatttaaaacttcatttttaatttaaaaggatctaggtgaagatcctttttgataatctcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgtccttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagcattgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgttctttcctgcgttatcccctgattctgtggataaccgtattaccgcctttgagtgagctgataccgctcgccgcagccgaacgaccgagcgcagcgagtcagtgagcgaggaagcggaagagcgcctgatgcggtattttctccttacgcatctgtgcggtatttcacaccgcatatggtgcactctcagtacaatctgctctgatgccgcatagttaagccagtatacactccgctatcgctacgtgactgggtcatggctgcgccccgacacccgccaacacccgctgacgcgccctgacgggcttgtctgctcccggcatccgcttacagacaagctgtgaccgtctccgggagctgcatgtgtcagaggttttcaccgtcatcaccgaaacgcgcgaggcaggctggctgttttacgcgtatgacaggctccggaagacggttgttgcgcacgtattcggtgaacgcactatggcgacgctggggcgtcttatgagcctgctgtcaccctttgacgtggtgatatggatgacggatggctggccgctgtatgaatcccgcctgaagggaaagctgcacgtaatcagcaagcgatatacgcagcgaattgagcggcataacctgaatctgaggcagcacctggcacggctgggacggaagtcgctgtcgttctcaaaatcggtggagctgcatgacaaagtcatcgggcattatctgaacataaaacactatcaataagttggagtcattaccaaaaggttaggaatacggttagccatttgcctgcttttatatagttcatatgggattcacctttatgttgataagaaataaaagaaaatgccaataggatatcggcattttcttttgcgtttttatttgttaactgttaattgtccttgttcaaggatgctgtctttgacaacagatgttttcttgcctttgatgttcagcaggaagcttggcgcaaacgttgattgtttgtctgcgtagaatcctctgtttgtcatatagcttgtaatcacgacattgtttcctttcgcttgaggtacagcgaagtgtgagtaagtaaaggttacatcgttaggatcaagatccatttttaacacaaggccagttttgttcagcggcttgtatgggccagttaaagaattagaaacataaccaagcatgtaaatatcgttagacgtaatgccgtcaatcgtcatttttgatccgcgggagtcagtgaacaggtaccatttgccgttcattttaaagacgttcgcgcgttcaatttcatctgttactgtgttagatgcaatcagcggtttcatcacttttttcagtgtgtaatcatcgtttagctcaatcataccgagagcgccgtttgctaactcagccgtgcgttttttatcgctttgcagaagtttttgactttcttgacggaagaatgatgtgcttttgccatagtatgctttgttaaataaagattcttcgccttggtagccatcttcagttccagtgtttgcttcaaatactaagtatttgtggcctttatcttctacgtagtgaggatctctcagcgtatggttgtcgcctgagctgtagttgccttcatcgatgaactgctgtacattttgatacgtttttccgtcaccgtcaaagattgatttataatcctctacaccgttgatgttcaaagagctgtctgatgctgatacgttaacttgtgcagttgtcagtgtttgtttgccgtaatgtttaccggagaaatcagtgtagaataaacggatttttccgtcagatgtaaatgtggctgaacctgaccattcttgtgtttggtcttttaggatagaatcatttgcatcgaatttgtcgctgtctttaaagacgcggccagcgtttttccagctgtcaatagaagtttcgccgactttttgatagaacatgtaaatcgatgtgtcatccgcatttttaggatctccggctaatgcaaagacgatgtggtagccgtgatagtttgcgacagtgccgtcagcgttttgtaatggccagctgtcccaaacctccaggccttttgcagaagagatatttttaattgtggacgaatcgaattcaggaacttgatatttttcatttttttgctgttcagggatttgcagcatatcatggcgtgtaatatgggaaatgccgtatgtttccttatatggcttttggttcgtttctttcgcaaacgcttgagttgcgcctcctgccagcagtgcggtagtaaaggttaatactgttgcttgttttgcaaactttttgatgttcatcgttcatgtctccttttttatgtactgtgttagcggtctgcttcttccagccctcctgtttgaagatggcaagttagttacgcacaataaaaaaagacctaaaatatgtaaggggtgacgccaaagtatacactttgccctttacacattttaggtcttgcctgctttatcagtaacaaacccgcgcgatttacttttcgacctcattctattagactctcgtttggattgcaactggtctattttcctcttttgtttgatagaaaatcataaaaggatttgcagactacgggcctaaagaactaaaaaatctatctgtttcttttcattctctgtattttttatagtttctgttgcatgggcataaagttgcctttttaatcacaattcagaaaatatcataatatctcatttcactaaataatagtgaacggcaggtatatgtgatgggttaaaaaggatcgatcctctagctagagtcgacctgcatcccttaacttacttattaaataatttatagctattgaaaagagataagaattgttcaaagctaatattgtttaaatcgtcaattcctgcatgttttaaggaattgttaaattgattttttgtaaatattttcttgtattctttgttaacccatttcataacgaaataattatacttttgtttatctttgtgtgatattcttgatttttttctacttaatctgataagtgagctattcactttaggtttaggatgaaaactagaggatctcaatgaatattggttgacacgggcgtataagacatgttatactgttgaataacaaggacggatctgatcaagagacaggatgaggatcgtttcgcatgattgaacaagatggattgcacgcaggttctccggccgcttgggtggagaggctattcggctatgactgggcacaacagacaatcggctgctctgatgccgccgtgttccggctgtcagcgcaggggcgcccggttctttttgtcaagaccgacctgtccggtgccctgaatgaactgcaggacgaggcagcgcggctatcgtggctggccacgacgggcgttccttgcgcagctgtgctcgacgttgtcactgaagcgggaagggactggctgctattgggcgaagtgccggggcaggatctcctgtcatctcaccttgctcctgccgagaaagtatccatcatggctgatgcaatgcggcggctgcatacgcttgatccggctacctgcccattcgaccaccaagcgaaacatcgcatcgagcgagcacgtactcggatggaagccggtcttgtcgatcaggatgatctggacgaagagcatcaggggctcgcgccagccgaactgttcgccaggctcaaggcgcgcatgcccgacggcgaggatctcgtcgtgacccatggcgatgcctgcttgccgaatatcatggtggaaaatggccgcttttctggattcatcgactgtggccggctgggtgtggcggaccgctatcaggacatagcgttggctacccgtgatattgctgaagagcttggcggcgaatgggctgaccgcttcctcgtgctttacggtatcgccgctcccgattcgcagcgcatcgccttctatcgccttcttgacgagttcttctgagcgggactctggggttcgaaatgaccgaccaagcgacgcccaacctgccatcacgagatttcgattccaccgccgccttctatgaaaggttgggcttcggaatcgttttccgggacgccggctggatgatcctccagcgcggggatctcatgctggagttcttcgcccaccggggatcctctagactgcgatgagtggcagggcggggcgtaatttttttaaggcagttattggtgcccttaaacgcctggtgctacgcctgaataagtgataataagcggatgaatggcagaaattcgatatctagatctcgagctggatacttcccgtccgccagggggacatgccggcgatgctgaaggtcgcgcgcattcccgatgaagaggccggttaccgcctgtttgaggatatagtaatctttctaaatagctttggattggaggagtatggccactaatactaagttcagctaataaaaaaatttgctaaagaactccagctggatttcactgatgagaatatcgtcggagataaatataataattccacggactatagactatactagtttaattaagtctagagtcgactgtttaaacctgcaggcatgccacgacaatcgctgtccttacaaactatgctgcccgacgcgatgcacaccttggcacgccgcgcagtccctatttcttcgtcgccgaacagggcggcagattgctgcatcaatacgtgcaccgggtgttctggcgactatcccggcaaattggtttacggcaggagggggatcgcggtggcccgcgggttcacgatcttcgtcaccgtttcgccgtccaaaccctgatcaactggcatcgcgctggcgaagatgtggaacgcgagctgccggtactctcgaccttcctcggccatgccaatgttcgcgacacctactggtatctgtccgccgcgccggagctgatgaatcatgccgttcggcgattggataagcggtgggaggttcggtcatgagacgaacgaacgacttagccgtgctgatcgagcggtggttcacagatcggctcatgaagcatcgaggtgtaagttccaacaccattgcctcctatcgagacacgttcaggctcctgtttgcgttcgcgcaggcgcgccttgggaggtccccatctcaattgacactgcgggatttggacgctccgttcatcggcgcattcctggaagtcctcgagacgcagagagccgcctcggtgaggacccggaatctccgcctcacagccattcgatctttcttccgatatgcggcgttcgaggagccggcacatagcgcccacatccagcgcgtgctcgcgatccccagcaagcgatgcgacaagcggcagcttcagttcctaaccaggcccgagattgaatcgatcctggactgcacggatcgaagcacgtggctgggacgccgcgattacactctgctattgctggccgcgcaaacggggctgcgggtttcggaagtcatcgacctcgaccgagactcggtaatgctcggccgcggtgcgcatgtgcaatgcgtcggtaagggccgcaaagagcgaagtacgccgctcacaaaggttgcacaggaagccctccggcgttggctcaaggaaccagggaagcgaggcgcaacggctctctttccgaatatgcacggtggcaggctcagcgccgacggcgtgcaggcactgctgaacaaatatgtcgccaaagcgcgcgagcactgcgtctccctccgctcgaagcgggtgtcgccccacgtcttgcggcacagcgctgccatggagctactacaggcgggcgtcgactgctcggtcattgccctgtggctgggccatgaggcgatggaaacgacgctgacctatcttcatgcacatcttgaactgaaggaatcgacactcgcaaagctgaagccgtacgaacgcgccaaggccgagcgatttcgaccaaacgaccggcttctggaattcctgaacgccctctgagcatgagaactatgccgagtgccaacgacgggtcttcgaccaaaacggcaagagaagcgcgtttcaactggtaagttggaagaggtgctcggcatagttcgccggtcggcataaaccgccttatgccgcgcgcggcataatgctgtcatgatcagtgtcgccatgaaggcggcgcgatcggcacctcgatccgatccggcgaagagccatgacttcctcccgagagcaaagcctctcagcgctcgttcggccgcgttgttcgtgagacaaatcctgccctcgtcgaggaaagacgtgaagccgttccagcgcttcagcatgtagtcgatcggctcggcgactggagaactgcgcgacagttttgcccgttcggtttgaagccagcagtgcagttcgccgacaagcggcaggctgtccttgcgacggcgctccaggcgttccgctgcggcaagcccgttgatctgccgctcgatgtcgaacagggcatcgatccgtttgacggcctccaacgccataggcgagatcggtgcggcgcggctgccgcgtttggcattcgtggcgatgtcggccagcacgaagaacttgcgcctcgcgtgcgaccagcagagcgcctgcgtcagcggccccggatcgcgggtctaccttgaacagcggattgtagccgccaatatgttctgccgaacatatcgggggctatgttgcggccgtccatatgtggccctgctgacctataccctttgtcaactgagtatttgggcccggatccaattcctttaagctctcgatgccccggtcggtgaaggtcgtgacgccctcttggctgccgtcatgggcatggatcatctcgccgtaatcgatattgtctgagttgctggcgatttcctggaggagttcgaggttctcgccgatcagcgaagcaacataatcgatcgtgtagacatgcgtcgggcgcgctgaccttgccccgttgtgagccgctaagcgcattgtcctcaccaccagctcatgtgctgtaacgcgcgaagctgtcgcaggctgtaccctctataagttaaggtacaactctgccgttggatgaattagcctcctgaaacgcttcctttacgtggctgatcaaagcacgttcagtctcgttaagcggcgtggaggtggagaatattgcccatagtcgccgcggcgggactaaatggtcgagagagaacgtgtccacgatccctgcctcgatctccttgatcatcaccgacgctggcaagatcgtgccaagaggtgaacgacgcaaaaccgagacgatcagaggtaccgaacccaaccgcattaccggctcgagctgcacagtagacttcgcaagtgccgtcagaagagtttgatgcattgtgagctgtgaaggtgccagaaggagcgggatgctcctcagctcgtctgccgaaactctctcggcctgaggcgcaaaattcagcttcctattgacgatcaggacgacgtcttcgctgcggccaattagtagagagcctacttgcggatcgatcctaccaacgacagcaatattgaaacggccggttagaacgccatgatgcagtacatgtcgagggccctccacaacctcgatttggcagttcggaaaattcattgtgaaatgcgctaagcgccacggccatgcattcggacgtcaaggaatctgcgctccaactcaccggtaacgcaatccgaattgattgttcaaaggccgcagctatgtggcttcgttcgcccagagtgtcgttgaaagccctctcaacgccgacaaacagcgaatgcagcctttcagcatcatcggtcggttcagaaccggtcttcttccggtcgataagccttgtcccgagcgcatattcgatctgttcaagctgggccggtatcatcggagcagtccgtccggcgacgcgggcagcgctcgccatgctgccggtctgcaccacacgattcacggtagaaatctgcttcaggctaaccttgggatggaaattcgtggcttcggaccagcccgaaggggcctcgacgcctttgcggacatcatttagcagatttaacagaagttcatggtcgttagagagctctgcggtcacgcagcacgacggactgcgaattaccggaaccgcagtgatgccctggatgcgaagacgctggggtacagtcagttggggcagaagtagatccgacttgcggatgtcgtcgatgagccctcggagatcctgcagacttcgatcggtggtggaaatccgtgatgtcgcgataccgctggagcggtcgaatttcgtgtcgctttgcagtgtacccggcagatcgggaatttcggtttttggagcaatgtcaccacgctcgggtcgctccccaaccgtatgggtcagcctcgtccaatggtctggagcaacgacaacagaaggtccggataccccagtaccgatggtatgttggatcttgagctgcccgagtggcaccgcgtctgacagaagatggctgggaccgttctgcattccgaaggcgccagtacccgtgaagatcaagtctacataagggtggtcgggtttggaatggaagcggcggatcgccgtgattacagcgtaggaaattgctgtccaggtatagtcaacgtctaatttgaggatgacgggcgccgaaggcgccgcgctgccgccaagtttggcatgactcaaatattcctcggcaaggaggagacgaacactgcgattgtacagccagaccgccgagcgtagcggaaaggagttacgccctttgcgaccaaaaagcgtcactccaatctgggcttcgagcgtgctgagcttggcatctcaatgccgatggtgtgagaccaagcttcgc

SEQ ID NO: 24 - DNA, 185498 bp, Artificial
  pRi2659(delta), a disarmed pRI2659-derivative from Agrobacterium strain K599 (NCPPB 2659)
  CDS (384)..(1400): rcorf1, similar to mll6374-like, integrase/recombinase [Mesorhizobium loti MAFF303099]
  misc_feature (1522)..(2085): rcorf2 (complement), similar to riorf1 in pRi1724, orf3 gene homolog in IS66
  misc_feature (2171)..(4247): right T-DNA flanking region in pRi2659 from Agrobacterium strain K599.
  misc_feature (2451)..(3905): rcorf3 (complement), weakly similar to mlr6097, nitrogen assimilation control protein [Mesorhizobium loti MAFF303099], COG0583 [K] Transcriptional regulator
  misc_feature (4880)..(6580): rcorf4 (complement), N-term similar to STH1062, similar to glutamine ABC transporter ATP-binding protein [Symbiobacterium thermophilum IAM 14863]; C-term similar to bll6362, hypothetical protein in Bradyrhizobium japonicum USDA 110, COG2079 [R]
  misc_feature (6582)..(7349): rcorf5 (complement), similar to Bcep02000339 [Burkholderia fungorum LB400], similar to blr3310, COG0765: ABC transporter permease protein [Bradyrhizobium japonicum USDA 110]
  misc_feature (7437)..(8159): rcorf6 (complement), similar to COG0765  [Burkholderia fungorum LB400], similar to PSPTO5181, cystine ABC tranporter, permease protein, putative [Pseudomonas syringae pv. tomato str. DC3000]
  misc_feature (8301)..(9200): rcorf7 (complement), similar to COG0834 Burkholderia fungorum LB400 COG0834, similar to STH1060, glutamine ABC transporter substrate-binding protein [Symbiobacterium thermophilum IAM 14863]
  misc_feature (9335)..(11320): rcorf8 (complement), similar to A. tumefaciens C58 hydantoin utilization protein hyuB
  misc_feature (11323)..(13374): rcorf9 (complement), similar to A. tumefaciens C58 hydantoin utilization protein hyuA
  misc_feature (13635)..(14417): rcorf10 (complement), similar to transcriptional regulatory protein [Bradyrhizobium japonicum USDA 110], helix_turn_helix gluconate operon transcriptional repressor
  misc_feature (14588)..(16117): rcorf11 (complement), similar to riorf40 in pRi1724, a hutH gene homolog, a cd01441: HAL; Histidine ammonia-lyase (HAL) catalyzes the first step in the degradation of histidine to glutamate
  misc_feature (16300)..(17388): rcorf12 (complement), weakly similar to riorf20 in pRi1724, similar to hypothetical protein Bcep02000338 [Burkholderia fungorum LB400].
  CDS (17638)..(18585): rcorf13, weakly similar to riorf22 in pRi1724, similar to hypothetical protein Bcep02000337 [Burkholderia fungorum LB400]
  CDS (19036)..(20124): rcorf14, probable cucumbopine transporter gene, similar to riorf37 in pRi1724, a probable mikimopine transporter
  misc_feature (20088)..(21206): rcorf15, similar to SMa2207, a putative ABC transporter, ATP-binding protein [Sinorhizobium meliloti 1021], a COG3842: PotA; ABC-type spermidine/putrescine transport systems, ATPase components [Amino acid transport and metabolism]
  CDS (21175)..(22086): rcorf16, similar to SMa2205 Sinorhizobium meliloti 1021 (strain: 1021), a COG1176 [E] ABC-type spermidine/putrescine transport system, permease component I
  misc_feature (22083)..(22928): rcorf17, probable cucumbopine transporter, similar to riorf34, a hypothetical protein [Agrobacterium rhizogenes] the probable mikimopine transporter gene
  misc_feature (23086)..(24447): rcorf18 (complement), similar to AGR_L_1821 hypothetical protein [Agrobacterium tumefaciens str. C58], a sdeB gene homolog, cd01298: ATZ_TRZ_like; TRZ/ATZ family contains enzymes from the atrazine degradation pathway and related hydrolases
  CDS (24529)..(25746): rcorf19, similar to hutI, imidazolone-5-propionate hydrolase [Agrobacterium tumefaciens str. C58], less similar to riorf39 in pRi1724, KEGG pathway: Histidine metabolism 00340.
  CDS (25816)..(26685): rcorf20, similar to riorf41 in pRi1724, a hypothetical protein
  CDS (26705)..(28390): rcorf21, similar to riorf42 in pRi1724, a hutU gene homolog, a urocanase, EC number 4.2.1.49
  CDS (28396)..(28962): rcorf22, similar to protein of unknown function DUF886 [Mesorhizobium sp. BNC1] and less similar to riorf43 in pRi1724, similar to unknown gene next to hutR gene in Pseudomonas putida
  CDS (29489)..(30100): rcorf23, similar C-term similar to IS30 family transposase
  misc_feature (30394)..(30852): rcorf24(complement), similar to riorf51 in pRi1724, weakly similar to mtrR gene of the tetR bacterial regulatory family.
  misc_feature (31227)..(31736): rcorf25 (complement), similar to riorf52 in pRi1724, similar MCA2182 decarboxylase family protein [Methylococcus capsulatus str. Bath]
  misc_feature (31912)..(32541): rcorf26 (complement), probable idi gene, similar to riorf53 in pRi1724, similar to idi, isopentenyl-diphosphate delta-isomerase [Mycobacterium tuberculosis CDC1551] EC 5.3.3.2.
  misc_feature (32579)..(33358): rcorf27 (complement), probable trans-zeatin synthase, similar to riorf54 in pRi1724, EC 2.5.1.-.
  misc_feature (34423)..(39729): rcorf28 (complement), probable GALLS gene, similar to riorf55 in pRi1724, complements virE2, unknow mechanism, required for efficient stable plant transformation.
  misc_feature (40899)..(41645): rcorf29 (complement), similar to riorf57 in pRi1724, a eutC homolog, ethanolamine ammonia-lyase light chain
  misc_feature (41642)..(43033): rcorf30(complement), similar to riorf58 in pRi1724, a eutB homolog, ethanolamine ammonia-lyase heavy chain
  misc_feature (43308)..(44096): rcorf31 (complement), similar riorf59 in pRi1724, similar to orf3 gene in Methylobacterium extorquens, COG3931 [E] Predicted N-formylglutamate
  CDS (44674)..(45927): rcorf32, similar to riorf60 in pRi1724, similar to gatA-1 gene [Glutamyl-tRNA amidotransferase, subunit A (gatA-1) Sulfolobus solfataricus P2]
  misc_feature (45900)..(47465): rcorf33, similar to riorf61 in pRi1724, hypothetical ABC-transporter gene similar to PH0807, pfam00496: SBP_bac_5; Bacterial extracellular solute-binding proteins, family 5
  CDS (47656)..(48507): rcorf34, similar to riorf62 in pRi1724, hypothetical ABC-transporter gene similar to agaB gene, agropinic acid permease, pfam00528: BPD_transp_1; Binding-protein-dependent transport system inner membrane component
  CDS (48509)..(49426): rcorf35, similar to riorf63 in pRi1724, hypothetical ABC-transporter gene similar to dppC gene, pfam00528: BPD_transp_1; Binding-protein-dependent transport system inner membrane component
  CDS (49727)..(51238): rcorf36, similar to riorf64 in pRi1724, hypothetical ABC-transporter gene similar to moaD gene, mannopinic acid permease, COG1123: ATPase components of various ABC-type transport systems.
  CDS (51979)..(53244): rcorf37, similar to riorf66 in pRi1724, similar to amaB gene, N-carbamoyl-beta-alanine amidohydrolase.
  misc_feature (53234)..(54163): rcorf38, similar to riorf67 in pRI1724, weakly similar to pck gene, smart00587: CHK; ZnF_C4 abd HLH domain containing kinases domain.
  CDS (54145)..(55113): rcorf39, similar to riorf68 in pRi1724, weakly similar to pck gene, pfam01633: Choline_kinase; Choline/ethanolamine kinase.
  CDS (55117)..(55908): rcorf40, similar to riorf69 in pRi1724, similar to MLCB1779.29 (probable monophosphatase gene) in Mycobacterium leprae, cd01641: Bacterial_IMPase_like_1; Predominantly bacterial family of Mg++ dependend phosphatases, related to inositol monophosphatases
  CDS (57224)..(59542): rcorf41, similar to riorf71 in pRi1724, hypothetical chemoreceptor gene similar to orf2 gene in pTi15955
  misc_feature (59661)..(60779): rcorf42 (complement), similar to riorf73 in pRi1724, hypothetical repressor gene, similar to SMa2004 [Sinorhizobium meliloti 1021], putative ROK-family transcriptional regulator.
  misc_feature (60825)..(61493): rcorf43 (complement), similar to riorf73 in pRI1724, similar to SMa2002 [Sinorhizobium meliloti 1021], COG2755 [E] Lysophospholipase L1 and related esterases.
  CDS (61709)..(62851): rcorf44, similar to riorf74, similar to teuB (periplasmic sugar binding protein) gene, COG1879: RbsB; ABC-type sugar transport system, periplasmic component [Carbohydrate transport and metabolism].
  CDS (62899)..(64434): rcorf45, similar to riorf75 in pRi1724, similar to teuA (ATP-binding sugar ABC transporter) gene, hypothetical ABC-transporter gene, COG1129: MglA; ABC-type sugar transport system, ATPase component [Carbohydrate transport and metabolism].
  CDS (64457)..(65419): rcorf46, similar to riorf76 in pRi1724, similar to teuC1 (sugar ABC transporter-permease) gene, a hypothetical ABC-transporter gene, pfam02653: BPD_transp_2; Branched-chain amino acid transport system / permease component.
  CDS (65421)..(66374): rcorf47, similar to riorf77 in pRi1724, similar to teuC2 (sugar ABC transporter-permease) gene, a hypothetical ABC-transporter gene, pfam02653: BPD_transp_2; Branched-chain amino acid transport system / permease component.
  CDS (66397)..(67080): rcorf48, similar to riorf78 in pRi1724, a COG2755 [E] Lysophospholipase L1 and related esterases.
  misc_feature (67162)..(68664): rcorf49, similar to riorf79 in pRi1724, a glpK (glycerol kinase) gene homolog, EC 2.7.1.30.
  CDS (68616)..(70217): rcorf50, similar to riorf80 of pRi1724, a glpD gene homolog, glycerol-3-phosphate dehydrogenase [Agrobacterium tumefaciens str. C58]
  CDS (70283)..(72241): rcorf51, similar to riorf81 in pRi1724, a acs(acetyl-CoA synthetase) gene homolog, EC 6.2.1.1.
  CDS (72263)..(72847): rcorf52, similar to riorf82 of pRi1724, a adk gene homolog, pfam00406: ADK; Adenylate kinase, EC 2.7.4.3.
  CDS (72905)..(75109): rcorf53, similar to riorf83 in pRi1724, a hypothetical chemoreceptor gene similar to orf2 gene in pTi15955
  CDS (75208)..(76215): rcorf54, similar to riorf84, a cbbF gene homolog, a cd00354: FBPase; Fructose-1,6-bisphosphatase, an enzyme that catalyzes the hydrolysis of fructose-1,6-biphosphate into fructose-6-phosphate and is critical in gluconeogenesis pathway.
  CDS (76216)..(77256): rcorf55, cbbA gene homolog, a cd00947: TBP_aldolase_IIB; Tagatose-1,6-bisphosphate (TBP) aldolase and related Type B Class II aldolases
  CDS (77313)..(78023): rcorf56, similar to pdb Chain A, Yeast Triosephosphate Isomerase (tri1)
  CDS (78328)..(78819): rcorf57, similar to riorf88 in pRi1724 and to phrR gene, DNA binding protein, helix-turn-helix XRE family.
  CDS (79212)..(79796): rcorf58, similar to riorf89 in pRi1724 and to thcR gene, conserved domain, HTH_ARAC; helix_turn_helix, arabinose operon control protein
  CDS (80189)..(81475): rcorf59, similar to riorf90 in pRi1724 and Atu6096 in pTiC58, conserved in Mesorhizobium and Agrobacterium species.
  CDS (81545)..(82150): rcorf60, similar to riorf91 in pRI1724, also similar to several hypothetical proteins in Agrobacterium, Mesorhizobium and Nitrobacter species.
  CDS (82163)..(82564): rcorf61, similar to riorf92 in pRi1724, hypothetical protein conserved in several Agrobacterium and Mesorhizobium strains.
  CDS (82683)..(87791): rcorf62, similar to riorf93, similar to jhp0928 gene in Helicobacter pylori, a COG0827; Adenine-specific DNA methylase [DNA replication, recombination, and repair].
  CDS (88692)..(90443): rcorf63, similar to AGR_pTi_191 partitioning protein Agrobacterium tumefaciens str. C58, partitioning protein, COG1475 [K] Predicted transcriptional regulators.
  CDS (90509)..(91015): rcorf64, similar to hypothetical protein MesoDRAFT_1041 [Mesorhizobium sp. BNC1], conserved in Agrobacterium, Mesorhizobium, and Nitrobacter speices.
  misc_feature (91012)..(91899): rcorf65, similar riorf95 in pRI1724, similar to downstream region of nylA gene in pOAD2.
  CDS (91899)..(92243): rcorf66, similar to hypothetical protein MesoDRAFT_1043 [Mesorhizobium sp. BNC1], conserved in Agrobacterium, Mesorhizobium, and Nitrobacter species.
  CDS (92248)..(92712): rcorf67, similar to riorf96 in pRi1724, a hypothetical protein weakly similar to downstream region of hydL gene in Thiocapsa roseopersicina.
  CDS (93036)..(93623): rcorf68, similar to AGR_pTi_204 [Agrobacterium tumefaciens str. C58] and argG, argininosuccinate synthase, from Streptomyces clavuligerus
  CDS (94316)..(95533): rcorf69, similar to riorf100 in pRi1724, similar to ardC gene in pSa(IncW plasmid) COG4227, probable conjugal transfer protein (antirestriction protein).
  CDS (95899)..(96420): rcorf70, similar to riorf101 in pRI1724, similar to mll9093 aspartate 1-decarboxylase [Mesorhizobium loti MAFF303099] and pgi gene in Xanthomonas citri, COG0853 [H] Aspartate 1-decarboxylase.
  CDS (99148)..(100236): rcorf71, similar to similar to riorf106 in pRi1724, similar to a teuB gene in pRtrCFN299a, a COG1879: RbsB; ABC-type sugar transport system, periplasmic component [Carbohydrate transport and metabolism].
  CDS (100378)..(102684): rcorf72, similar to riorf107 in pRi1724, similar to mcpC (mcpC gene in Rhizobium) gene in Rhizobium leguminosarum, a smart00283: MA; Methyl-accepting chemotaxis-like domains (chemotaxis sensory transducer).
  misc_feature (103421)..(104020): rcorf73 (complement), similar to AGR_pTi_225 nuclease [Agrobacterium tumefaciens str. C58], a COG1525 [L] Micrococcal nuclease (thermonuclease) homologs.
  misc_feature (104017)..(106020): rcorf74 (complement), probable traG gene, similar to riorf109 in pRi1724, a cd01126: TraG_VirD4; The TraG/TraD/VirD4 family are bacterial conjugation proteins.
  misc_feature (106007)..(106222): rcorf75 (complement), probable traD gene, conjugal transfer protein.
  misc_feature (106242)..(106535): rcorf76 (complement), probable traC gene, Ti plasmid conjugal DNA processing, similar to riorf111 in pRi1724.
  misc_feature (106682)..(106713): probable conjugal transfer origin
  CDS (106784)..(110110): rcorf77, probable traA gene, similar to riorf112 in pRi1724, COG0507: RecD; ATP-dependent exoDNAse (exonuclease V), alpha subunit - helicase superfamily I member [DNA replication, recombination, and repair].
  misc_feature (110107)..(110673): rcorf78, probable traF gene, similar to riorf113 in pRi1724, COG4959: TraF; Type IV secretory pathway, protease TraF [Posttranslational modification, protein turnover, chaperones / Intracellular trafficking and secretion].
  CDS (110663)..(111826): rcorf79, probable traB gene, similar to riorf114 in pRi1724.
  CDS (111838)..(112452): rcorf80, similar to riorf115 in pRi1724, a hypothetical protein of Agrobacterium rhizogenes (strain: MAFF03-01724).
  misc_feature (112708)..(112896): rcorf81 (complement), similar to riorf117 in pRi1724, a hypothetical protein or Agrobacterium rhizogenes (strain: MAFF03-01724), a cd00093: HTH_XRE; Helix-turn-helix XRE-family like proteins.
  CDS (113132)..(113455): rcorf82, probable traM gene similar to riorf118 in pRi1724, TraR antagonist.
  misc_feature (113460)..(114134): rcorf83 (complement), probable traR gene similar to riorf119 in pRi1724 and traR/AGR pTi 249 in pTiC58.
  misc_feature (114510)..(115802): rcorf84 (complement), probable trbI gene similar to riorf120 in pRi1724, a pfam03743: TrbI; Bacterial conjugation TrbI-like protein.
  misc_feature (115814)..(116254): rcorf85 (complement), probable trbH gene similar to riorf121 in pRi1724, Type IV transfer system required for Ri/Ti plasmid conjugation.
  misc_feature (116258)..(117070): rcorf86 (complement), probable trbG gene similar to riorf122 in pRi1724, Type IV transfer system required for Ri/Ti plasmid conjugation.
  misc_feature (117087)..(117749): rcorf87 (complement), probable trbF gene similar to riorf123 in pRi1724, Type IV transfer system required for Ri/Ti plasmid conjugation
  misc_feature (117770)..(118951): rcorf88 (complement), probable trbF gene similar to riorf123 in pRi1724, Type IV transfer system required for Ri/Ti plasmid conjugation.
  misc_feature (119029)..(119145): rcorf89 (complement), trbK gene homolog similar to riorf125 in pRi1724, Type IV transfer system required for Ri/Ti plasmid conjugation.
  misc_feature (119142)..(119993): rcorf90 (complement), probable trbJ gene similar to riorf126 in pRi1724, Type IV transfer system required for Ri/Ti plasmid conjugation, COG5314; Conjugal transfer/entry exclusion protein [Intracellular trafficking and secretion].
  misc_feature (119917)..(122373): rcorf91 (complement), probable trbE gene similar to riorf127 in pRi1724, Type IV transfer system required for Ri/Ti plasmid conjugation.
  misc_feature (122384)..(122683): rcorf92 (complement), probable trbD gene similar to riorf128 in pRi1724, Type IV transfer system required for Ri/Ti plasmid conjugation.
  misc_feature (122676)..(123059): rcorf93 (complement), probable trbC gene similar to riorf129 in pRi1724, Type IV transfer system required for Ri/Ti plasmid conjugation.
  misc_feature (123534)..(123923): rcorf94 (complement), probable trbB gene similar to riorf130 in pRi1724, Type IV transfer system required for Ri/Ti plasmid conjugation
  misc_feature (124035)..(124658): rcorf95 (complement), probable traI gene similar to riorf131 in pRi1724, a LuxI-type quorum sensing regulators, synthesizes 3-oxooctanoylhomoserine lactone, a pfam00765: Autoind_synth; Autoinducer synthetase.
  CDS (124975)..(126249): rcorf96, probable repA gene similar to riorf132 Agrobacterium rhizogenes (strain: MAFF03-01724), a cd00550: ArsA_ATPase; Oxyanion-translocating ATPase (ArsA) and cd00592: HTH_MERR; Helix-turn-helix transcription regulator MERR, N-terminal domain.
  CDS (126343)..(127350): rcorf97, probable repB gene similar to riorf133 in pRi1724, a smart00470: ParB; ParB-like nuclease domain protein.
  CDS (127517)..(128728): rcorf98, probable repC gene similar to riorf134 in pRi1724, essential for vegetative replication.
  CDS (130131)..(130721): rcorf99, similar to riorf135 in pRi1724, weakly similar to y4aO gene in pNGR234a.
  misc_feature (132571)..(132882): rcorf100 (complement), similar to C-term of pAT 22 Agrobacterium tumefaciens str. C58 (strain: C58, isolate: Cereon), a COG0582 [L] Integrase protein.
  misc_feature (132883)..(133557): rcorf101 (complement), similar to N-term. fragment of pAT 22 Agrobacterium tumefaciens str. C58 (strain: C58, isolate: Cereon), a COG0582 [L] Integrase protein.
  misc_feature (133659)..(134810): rcorf102 (complement), similar to hypothetical integrase gene orf2 (similar to Pseudomonas integrase-like gene) in pTiA6NC.
  CDS (134936)..(135889): rcorf103, similar to riorf137 gene in pRi1724 and orf4 gene in pTiA6NC.
  misc_feature (135886)..(136587): rcorf104, similar to riorf138 in pRi1724 and gvp1 gene in pHH1, a pfam04079: DUF387; Putative transcriptional regulators (Ypuh-like) protein.
  CDS (136588)..(136923): rcorf105, similar to riorf139 in pRi1724, similar to uncharacterized region between y4jF and y4jG genes in pNGR234a.
  CDS (137628)..(138758): rcorf106, similar riorf140 in pRi1724 and to orf300 gene in Escherichia coli, a pfam00004: AAA; ATPase family associated with various cellular activities (AAA).
  CDS (138760)..(139875): rcorf107, similar to N-term of riorf141 in pRi1724, a hypothetical protein.
  misc_feature (139628)..(141019): rcorf108, similar to C-term of riorf141 in pRi1724, a hypothetical protein.
  CDS (141265)..(142305): rcorf109, weakly similar to SERP1653 Staphylococcus epidermidis RP62A (strain: RP62A), a hypothetical protein.
  CDS (142828)..(143328): rcorf110, similar to riorf142 in pRi1724, similar to gene for luminal binding protein exon 6 in Arabidopsis thaliana.
  CDS (143465)..(143854): rcorf111, similar to riorf143 in pRi1724 and to spdB3 gene in pSG5.
  CDS (144414)..(145682): rcorf112, similar to riorf144 in pRi1724.
  misc_feature (145541)..(146038): rcorf113, weak similar over 79 aa to blr8180 of Bradyrhizobium japonicum USDA 110 (strain: USDA 110), a COG1760 [E] L-serine deaminase.
  CDS (146549)..(147502): rcorf114, putative virF gene, similar to riorf146 in pRI1724 and tiorf133 in pTiSAKURA.
  misc_feature (147710)..(148519): rcorf115 (complement), similar to riorf147 in pRi1724 and y4mC gene in pNGR234a homolog, a vir induced gene.
  misc_feature (149614)..(151509): rcorf116 (complement), probable potassium uptake protein, similar to Atu0711 iAgrobacterium tumefaciens str. C58 and riorf148 in pRi1724 and to kup gene, a pfam02705: K_trans; K+ potassium transporter protein.
  CDS (151978)..(153057): rcorf117, similar to riorf149 in pRi1724, similar to N-term. aatA (atu2196) aspartate aminotransferase A [Agrobacterium tumefaciens str. C58].
  misc_feature (152756)..(153178): rcorf118, similar to riorf150 in pRi1724, aatA gene in Rhizobium leguminosarum homolog, hypothetical pseudogene which is divided by frame-shift.
  CDS (153108)..(154460): rcorf119, probable virH, similar to riorf151 in pRi1724, cytochrome P450-type oxidase, likely type IV secreted protein via virB/D4.
  CDS (154664)..(157219): rcorf120, probable virA, similar to riorf152 in pRi1724, receptor in two component virA/G regulatory system.
  CDS (157991)..(158713): rcorf121, probable virB1, similar to riorf153 in pRi1724, type IV secretion system require for T-complex transfer.
  misc_feature (158713)..(159078): rcorf122, probable virB2, similar to riorf154 in pRi1724, type IV secretion system require for T-complex transfer
  CDS (159075)..(159401): rcorf123, probable virB3, similar to riorf155 in pRi1724, type IV secretion system require for T-complex transfer
  misc_feature (159401)..(161770): rcorf124, probable virB4, similar to riorf156 in pRi1724, type IV secretion system require for T-complex transfer.
  CDS (161787)..(162455): rcorf125, probable virB5, similar to riorf157 in pRi1724, type IV secretion system require for T-complex transfer.
  CDS (162522)..(163409): rcorf126, probable virB6, similar to riorf158 in pRi1724, type IV secretion system require for T-complex transfer.
  CDS (163437)..(163604): rcorf127, probable virB7, similar to riorf159 in pRi1724, type IV secretion system require for T-complex transfer.
  misc_feature (163591)..(164304): rcorf128, probable virB8, similar to riorf160 in pRi1724, type IV secretion system require for T-complex transfer.
  CDS (164301)..(165179): rcorf129, probable virB9, similar to riorf161 in pRi1724, type IV secretion system require for T-complex transfer.
  misc_feature (165179)..(166309): rcorf130, probable virB10, similar to riorf162 in pRi1724, type IV secretion system require for T-complex transfer.
  CDS (166343)..(167377): rcorf131, probable virB11, similar to riorf163 in pRi1724, type IV secretion system require for T-complex transfer.
  CDS (167649)..(168338): rcorf132, probable virG, similar to riorf164 in pRi1724, activator in two component virA/G regulatory system.
  CDS (168445)..(168801): rcorf133 (complement), hypothetical protein, similar to aa1-103 pf ISBm1 transposase orfB [Brucella suis 1330] (NP 697552).
  misc_feature (168777)..(169142): rcorf134 (complement), hypothetical protein, similar to aa4-122/142 of ISBm1 transposase orfA [Brucella suis 1330] (NP 697551).
  misc_feature (169306)..(169911): rcorf135 (complement), probable virC2, similar to riorf165 in pRi1724, T-DNA processing virulence virA/G regulated protein.
  misc_feature (169914)..(170609): rcorf136 (complement), probable virC1, similar to riorf166 in pRi1724, virulence virA/G regulated protein, AGR_pTi_18p; VirC1; binds to overdrive sequence adjacent to right border of T-DNA; increases the level of T-DNA processing.
  CDS (170864)..(171310): rcorf137, probable virD1, similar to riorf167 in pRi1724, a virA/G regulate T-DNA border endonuclease accessory protein.
  CDS (171336)..(172682): rcorf138, probable virD2, similar to riorf168 in pRi1724, the virA/G regulated T-DNA border endonuclease.
  misc_feature (172513)..(175536): rcorf139, probable virD3, similar to riorf169 in pRi1724, virA/G regulated, not required for virulence, possible host range factor.
  CDS (175596)..(177578): rcorf140, probable virD4, similar to riorf170 in pRi1724, virA/G regulated component of virB/D4 Type IV secretion system.
  misc_feature (175596)..(177578): rcorf141, probable virD5, similar to riorf171 in pRi1724, virA/G regulated component of virB/D4 Type IV secretion system.
  CDS (180446)..(181375): rcorf142, probable virF, similar to riorf172 in pRi1724, and less similar to tiorf133 in pTi-SAKURA, a type IV secretion protein via virB/D4 complex.
  CDS (181479)..(182831): rcorf143, probable virE3, similar to riorf173 in pRi1724 and virE3 in pRiA6NC, interacts with virE2 and IMPA1 (AtKAP-alpha) in A. tumefaciens, virB/D4 type IV secreted protein.
  CDS (182937)..(183389): rcorf144, similar to Mesorhizobium loti MAFF303099 mlr1626, predicted mannose-6-phosphate isomerase.
  CDS (183737)..(184975): rcorf145, similar to phage integrase.
  misc_feature (184975)..(235): rcorf146, similar to Y4rB Rhizobium sp. NGR234.
gcatgccacgacaatcgctgtccttacaaactatgctgcccgacgcgatgcacacgcggccgcatgccgcgcagtccctatttcttcgtcgccgaacagggcggcagattgctgcatcaatacgtgcaccgggtgttctggcgactatcccggcaaattggtttacggcaggagggggatcgcggtggcccgcgggttcacgatcttcgtcaccgtttcgccgtccaaaccctgatcaactggcatcgcgctggcgaagatgtggaacgcgagctgccggtactctcgaccttcctcggccatgccaatgttcgcgacacctactggtatctgtccgccgcgccggagctgatgaatcatgccgttcggcgattggataagcggtgggaggttcggtcatgagacgaacgaacgacttagccgtgctgatcgagcggtggttcacagatcggctcatgaagcatcgaggtgtaagttccaacaccattgcctcctatcgagacacgttcaggctcctgtttgcgttcgcgcaggcgcgccttgggaggtccccatctcaattgacactgcgggatttggacgctccgttcatcggcgcattcctggaagtcctcgagacgcagagagccgcctcggtgaggacccggaatctccgcctcacagccattcgatctttcttccgatatgcggcgttcgaggagccggcacatagcgcccacatccagcgcgtgctcgcgatccccagcaagcgatgcgacaagcggcagcttcagttcctaaccaggcccgagattgaatcgatcctggactgcacggatcgaagcacgtggctgggacgccgcgattacactctgctattgctggccgcgcaaacggggctgcgggtttcggaagtcatcgacctcgaccgagactcggtaatgctcggccgcggtgcgcatgtgcaatgcgtcggtaagggccgcaaagagcgaagtacgccgctcacaaaggttgcacaggaagccctccggcgttggctcaaggaaccagggaagcgaggcgcaacggctctctttccgaatatgcacggtggcaggctcagcgccgacggcgtgcaggcactggttttcgctgctgtctatcgggcgcgcgagcactgcgtctccctccgctcgaagcgggtgtcgccccacgtcttgcggcacagcgctgccatggagctactacaggcgggcgtcgactgctcggtcattgccctgtggctgggccatgaggcgatggaaacgacgctgacctatcttcatgcacatcttgaactgaaggaatcgacactcgcaaagctgaagccgtacgaacgcgccaaggccgagcgatttcgaccaaacgaccggcttctggaattcctgaacgccctctgagcatgagaactatgccgagtgccaacgacgggtcttcgaccaaaaacggcaagagaagcgcgtttcaactggtaagttggaagaggtgctcggcatagttcgccggtcggcataaaccgccttatgccgcgcgcggcataatgctgtcatgatcagtgtcgccatgaaggcggcgcgatcggcacctcgatccgatccggcgaagagccatgacttcctcccgagagcaaagcctctcagcgctcgttcggccgcgttgttcgtgagacaaatcctgccctcgtcgaggaaagacgtgaagccgttccagcgcttcagcatgtagtcgatcggctcggcgactggagaactgcgcgacagttttgcccgttcggtttgaagccagcagtgcagttcgccgacaagcggcaggctgtccttgcgacggcgctccaggcgttccgctgcggcaagcccgttgatctgccgctcgatgtcgaacagggcatcgatccgtttgacggcctccaacgccataggcgagatcggtgcggcgcggctgccgcgtttggcattcgtggcgatgtcggccagcacgaagaacttgcgcctcgcgtgcgaccagcagagcgcctgcgtcagcggccccggatcgcggtctaccttgaacagcggattgtagccgccaatatgttctgccgaacatatcgggggcttgttgcggccgtccatatgtggccctgctgacctataccctttgtcaactgagtatttgggcccggatccaattcctttaagctctcgatgccccggtcggtgaaggtcgtgacgccctcttggctgccgtcatgggcatggatcatctcgccgtaatcgatattgtctgagttgctggcgatttcctggaggagttcgaggttctcgccgatcagcgaagcaacataatcgatcgtgtagacatgcgtcgggcgcgctgaccttgccccgttgtgagccgctaagcgcattgtcctcaccaccagctcatgtgctgtaacgcgcgaagctgtcgcaggctgtaccctctataagttaaggtacaactctgccgttggatgaattagcctcctgaaacgcttcctttacgtggctgatcaaagcacgttcagtctcgttaagcggcgtggaggtggagaatattgcccatagtcgccgcggcgggactaaatggtcgagagagaacgtgtccacgatccctgcctcgatctccttgatcatcaccgacgctggcaagatcgtgccaagaggtgaacgacgcaaaaccgagacgatcagaggtaccgaacccaaccgcattaccggctcgagctgcacagtagacttcgcaagtgccgtcagaagagtttgatgcattgtgagctgtgaaggtgccagaaggagcgggatgctcctcagctcgtctgccgaaactctctcggcctgaggcgcaaaattcagcttcctattgacgatcaggacgacgtcttcgctgcggccaattagtagagagcctacttgcggatcgatcctaccaacgacagcaatattgaaacggccggttagaacgccatgatgcagtacatgtcgagggccctccacaacctcgatttggcagttcggaaattcattgtgaaatgcgctaagcgccacggccatgcattcggacgtcaaggaatctgcgctccaactcaccggtaacgcaatccgaattgattgttcaaaggccgcagctatgtggcttcgttcgcccagagtgtcgttgaaagccctctcaacgccgacaaacagcgaatgcagcctttcagcatcatcggtcggttcagaaccggtcttcttccggtcgataagccttgtcccgagcgcatattcgatctgttcaagctgggccggtatcatcggagcagtccgtccggcgacgcgggcagcgctcgccatgctgccggtctgcaccacacgattcacggtagaaatctgcttcaggctaaccttgggatggaaattcgtggcttcggaccagcccgaaggggcctcgacgcctttgcggacatcatttagcagatttaacagaagttcatggtcgttagagagctctgcggtcacgcagcacgacggactgcgaattaccggaaccgcagtgatgccctggatgcgaagacgctggggtacagtcagttggggcagaagtagatccgacttgcggatgtcgtcgatgagccctcggagatcctgcagacttcgatcggtggtggaaatccgtgatgtcgcgataccgctggagcggtcgaatttcgtgtcgctttgcagtgtacccggcagatcgggaatttcggtttttggagcaatgtcaccacgctcgggtcgctccccaaccgtatgggtcagcctcgtccaatggtctggagcaacgacaacagaaggtccggataccccagtaccgatggtatgttggatcttgagctgcccgagtggcaccgcgtctgacagaagatggctgggaccgttctgcattccgaaggcgccagtacccgtgaagatcaagtctacataagggtggtcgggtttggaatggaagcggcggatcgccgtgattacagcgtaggaaattgctgtccaggtatagtcaacgtctaatttgaggatgacgggcgccgaaggcgccgcgctgccgccaagtttggcatgactcaaatattcctcggcaaggaggagacgaacactgcgattgtacagccagaccgccgagcgtagcggaaaggagttacgccctttgcgaccaaaaagcgtcactccaatctgggcttcgagcgtgctgagcttggcactcaatgccgccgttaattaaccaagcttcgcggccgcatgcgccatcgttggactgtcgcaactgacaacgaaagctgccagatgcggaaagtcgatcttgggcatactaacctcggatgaatgtgcgcatcagaaccttgcgcgagctctggagaccctatgctgaaaagatatcggacaaccgggttgccttgtccagatcacggatcgcccaaacatgctttccgaaatcggccaccctcgactgccttgcgcgggaaatgcctcccgccagtttcctggtgatttcctcccatccggctggatcgtcgggcgcccctcgcggcacacgccgccgctcggccagtcgctttccgtccaggaagaccacttcgatgtcggggttgtccgaatcctcactccgcgcgaacatcgccaccttgaccaatagctcggaaacgtcctcatgtgcgatggcgttcgtttcaaaatcgttcagcgttaactcgccttggagcagggcggtcgccaccgtatagttcatgctgaacttcgcctcgattcccgttctcggcttcggaaagcgcagatagcggatgcactcgtcgcggacgaaacagttgatccgttcgatcgctttgatgtcgaaaccagacagcgctcggatcgtcaatgcgccatcaattgcaagatgggtgcagaccagcccgggccgtcgaccacgcgtgccctatagtaacaagttcccaagggttgccgagagctggcaacgttgctgctgatccgcctgtgaatgcatccaggaaaccggatggtgcctcaaggatgccagatccggccgtgaagtcgctttctgccagctttgcagcaaggaagccagcttgagcggcccggccgcaatgcaaactcttcgtcatcgttccggtgttgccaaggatgcccccggcaaaggagcacgcgatcgcgagtgcgtgctccgtttggcgcgcgtcgaggccacgcaagttggccgcagcgccggcagctgcgagagtcccgagcgtcgacatcgtatgccacccttggcgcgtatgtgcgctgcccactgcgatgccaagcttgcaggcgatctcgatcccgactgcataggaccgcaggaatgcccggccgctcgcttgcgtttcgaaggccgtcggcagcagcgcactgacgatcggggcactcggatggccattcatcgagaactcgctcgtatcatcaaagtcgtctgcatgcgcgcaggtgccggtcagaagagccgccagtgcaggatcgctccagcaacctagaccagggacgggaatgccctcccgatcgttccctggtgcgcatactgcaacgagaatttctacaggccgagacgccgtgccagcatatatgcaagcgagtgtgtcggccacatggatctttgcgcgctcggacacagactgaggcacttcccgcacatgggcgatgaagtcggaaagctcggctgttatggacatgacaatgttcggacttgtgcgccttggaaatgaagaaaacaggccatgtcttgggcacctagcggagacgccggccgtaattcgccaactgtttaggagattcgctccaggaattcggccgtgcgagcgttttgggggcgaccaaaaaatctgctctggtggcccctgttcaatgatggagcccttatccatcacaacgactcggtcggccacctctcgtgcgaaacccatttcgtgagtgacgacgatcatggtcatgcccttgccggcgagttctttcatgacagagagaacttcgccgaccatttccggatcaagtgcgctggtcggctcgtcaaaaagaacaatctcgggcttcatcgcgagaacgcgagcaattgctacacgctgctgctggccacccgagagttgcgcgggatactgatctcgcttatcggccaatccgacgcgctccagcagggcaattccttcctggatcgcctcttgcctcgggcgctttagaacatgaacgggagcctcgatgatgttctgcagagcggtcagatgcggaaatagattgaagcgctggaaaaccatgccaacattcctgcggattgcggccttttccttctcgctgagtgggacctttttaccgcctgcgagcttgttgctcacaagtgcgccattcaggtagatctcaccgctctggatttgctccagatgattgatacaacggataagcgtcgttttgccggagccggacggaccgatgacgacaacggtctccttaggttggaccgtcattgaaacattcttgaacacgctcagggtaccgaacgacttgcttacgccgcggagttccacggcaggtgccacgctggctttggattgatcggccatttcaggtttccatctgtaacaggttgggggcgttcgactcgggctcgcgcgcagcagtgcgaggactccaggacagccggttctcgatccattgttgaaggacggtccacaccccggtcagcacgagatagtagacggagatcgccgcataaacttcgaaggtcttgaagttttgcgatcgcaggctgtcggcgacgtgtacgagttctggaacggcgatgacgctcaggaacgcagtggtcttgaacatcatgttgcattggtttccgagcgaggggaggatgatgcgaagcgcctgggggaggatgatccggcgcatcgccaacgacggcaacatgcccaatgcctgtgcggcctcgctttgtcctttctcgaccgatcggatgccggcccgcgtgatctcgctcatatatgctgcttcgtgcaagctgaatgcgaatatgccagcgacaatcgctccgctgatggaaaacgccggcgtcgtgattgtcgacgggaagatgtcaacaccgatcaggtagggcagcccaaaatagattagaaacaactgcacgaggataggagttcctcggaagaaccagacgtaaagccagttgaaacctctaagcgcgccatacaggctcagtccgaatagtgccaggaacagtcccgcaatgatcccgaccgccattgatgtgagagtgacggagacggtgagccagacagcatatataagctgcggtggtggcgagaaaaccagctcgaggaaatagtgcaggtcaaagttcatgattgagctcccggagcaacttcgccgccttcatgagaccgagtggcgttcgagcgactacgctcgccgaattgggtgcggaccaggtcatatcgaaacgaagccctttgaataacgcttctccaatgcttcttggagaaagctccaagcggttgtgagcgcgaggtagtagatcgatacgccgagatagacctcgaaggttttgtaggtcactgaattcactgcgtcggtgataaacagcatctctggaaccgcgatcaggtacagcaacgatgtcgccttgaacatgccgttcatctgattgccaagtggaggcaacatgatgcgaattgcctgtggcagaatgatccgctgcatgagaagccccggcgtcatgccgacggccctgccggcatcccactggccatggtcgaccgaagcgatagcgccgcgagaaatttcgctgaagtatgccgcctcatggagcgcgaaggcggtcacccccgcgacaatcgccccgctgatcgaaatgaagccgaacagatgcacgtcctgcggaaaaagatcgacattcgtcagataggggaggccgaaatagatcagaatgacctgcacaaggagcggtgtgccgcgaaacacgaagatgtaggcgctgttgaaccagcggagcacgcgccatcgtgatagtccgaacagggacaagacaagccccaacaccacaccgatgaccatggacgcgaacgcgaccagaaccgtcgtgagcagaccgcgcagaagggcgggccggggattgaagacaaaatccaggaaaaaggcgatatcgaactgcatgtcgataatgtccccgtttcttattgtgttcgagttccgttgccgaggaccttacctcttgcgcggagggctgccgccgaagcggcaggccaggagtgtacacctactcgaacctatcgagcgttgggcatctgcggaaaatcatgggcactgcttgtcgttgcggcaaagctcgacatggccgtccatgccccaggtcttggcggcctgctcgacatagccgctttcgtagagagagacataagccttgcgtacggcttcttgcagcgcagggtcgtccttgcgaagcacaataccgatggtgagggggtcgatcggtagaccgccgatctcatatttatcgccggtgagcttcttgaagtaggagagtgtcatcgcgtcgctcacgaaagcgtccacacgtttcagatcgagctgccggaacgtgaccgtattctgcggataggactggatctcgatcggtggcttgccttcggcgctgaccttggtgttggcttccttcagtaggcgttcgttggtgctcgagaccagaaccgcgacgcggtgtcctgaaagatcctcgtaagtcttgatattgagggggtttcctttcgggacaaggaggcccatccgctcgcgcacgtactccacgaaattgtattttgcgacgcgagctagacttttcgaattgttcgacatgactgcatcgcatttacccgtgtccaaagcagcgaagatactggcgaacggatagtggacgacttcggttttgatacccatcgccgggccaatcgccgacattacgtcaacattgaagcctttcggcgtgacgccgtcttcatccaggaagccgccggggggattgccgagttcggtgcacatgacaatcttgccggccttcgccagtttttcggttggctcgacgctcttcgtgattcccgaagccgcctggctgttttcatatgctttgccttcggatggctccgccgcctttgctgccggtgcgatacagactccggcaagaagtagattcacgatcaatgcgtaagaacgaattctcattgtattcccctttcttcttcacgatgttagatcgttttcactacgcgggacgcatctcctgtgatcgagaattacgtccaggtgttttggtttcggcaatgggcgatggtcgctggctattctccgctgttgttgtcatggacgcaccgctaagctgtcattgctgcaaaagccggttttcctccgcgagtgcattcgggattaaatcgagcgtcgctcttttgctttccttgatgaagcgcgaaaccgtattgcgtacgagggttgctctgaccgaagcgtcataatcaaaagaacggacggccagggcagcccggacgtcgatgggccagatggcgtcgaacgcctgtcgcgtttcacaatgcgagaatcggttgttgcccttgatcatggccgacctggctgcctcagtggccttcatatcgatcgtgaagtcatcgcgaattaccaccccgtaggccgcgcgagcttttttcagctgagacgacgccccgctttacgtccgcgagcacaagctcgggatctctctctgacgctggcccaaacccgccccccgccggagtgatcaggcggacgacgtcaccccgcttgaagtggagaacgtcaatcttgccgatctcacgttcatccttcgtgtcggggttgacgatgacgcgcgcgagggatccggcttcgccgcccatgataccccatggagtgaatttgagccgatccatgccgcgcaccgtcatgacggcctcaacgtcggtgttctccagatccaggaccaccgaggcgccgctgcgccaacgacccggtgcctggctgtcgatgacaaggccgtatcgttgaacgcgcatgatagtttcgacttcgatagtctccgccggcacggtcaaaagtgagcccgaccggttgtcgacgccatcgataccgtcgtgtcctattttaccgccaccgccgccgcaaattggattgatcacgctcacacgcttgccgccatgaagacggtcgcgtccggtgaccacgatgatccccgacatacccgggccagctgcggccagtcctccggggattgcggcgttcaagcaaccaagcacaacgtcgtagacgcgggtcgacgcggtgacgcgtgatccgccggcggctgggaagttcgcattgatgatcgttccgcggggagcgatgatcttgaccggccgcagaaggccacggttccggggagcgtctggcgcctttgtcaggatatagtagattagcgattgcagggtatagggatgtgtggtcgagccagtgacatagttgaaggctgcgaggacctgaggatccgttccggtaaaatcaaacagtaaatcgctgccggtgaccgtcatcttcgcatggatattgatgaattcaccggccttcataccctcaatgtagtcggcgaactcgtaaattccgtcgggaatttcggcgataacctcccgggccctcgcttctgatagggcgagcgttgcatccatcccgtcgatgacttcctgcgtcgaataccgatcacagagttggccgagacgcacatccatgctcttcatagcagagaacattgcttggatatcgccccacagctccgatgagatgcggctgttatcgagcaaaatgtttctgacggcctcgttgagaactccctcgcgatacagaagcacggggcggagcctcagcccctcctgaaatgtttccgtaagtgtcggcgctatgcttccgggaaccgcgccgccgatgtctgaggcatgcacgaaggcccatgccagcgctatgagccggccgtcgcggaagatcggatgcaccagcgacacatccatcatatgggtgaccatgccgtcgcttgagaatggatcattggttatgatgcagtctccaggcttcagggaggaaattgggatatcaccgagaccgcccttgaccgacagtccgatgaaggcgctgacaccggtatttacggggtaggcgaatgcttcaccctcagcatttgccaatgcgcactggaaatcctgaacgagcttcacgaaggttgtgtgagccgtacgctgaagggtcgaggatgcttcttcgacgatcgcgttgaaccggttcgccatgattgcagtttgtacgggatccatttttactgcctccgcgtcagtgcgagtgcgccggttgcgagggcgctcgcgtgaaatgctgctggtacgaggacggtagaatcgtcctcctcgatgacgcacggccccttgaccgtgctgccgacagtcaggtccttgcgccgataggtgctggcggaaggatggagctttccggcaatgcggatgtcgcgctgcccaacgggcgcaatttcagcacgaggcccaagtggagcgtgctcgtctggaggcataggcagactgccccggacacgcacgcgcagttcaacgaactccactggcgcagccgtgtcgcaatggctgtaaagccgcagatgctcatcatggaaacgattggcaatagacgtaagatcgggaaatctgccatgactgacaggcactgcgaccgcgacttggaatgactgtcccctatatctcagctcggcccagaactcgtgttccaccgaaaccagtcgggatccgtcgatctggttcgataaccagaccagggtctcatccttgagcttttcgaattccgccgccacgagttcgtcggtgacggtcgaaccctggatcaccgcaatgacatcgtgtgtaagtgaagtcacgaccccgccccgagcgcagaagaccgagggagcgggcggcacgatgatcgaattgatgccgacctcatcggccagaagcggaccatgtagcgcaccattgccgccgaatagcacgagggtgacgttttgcgggtcgaggccatgggcggcaagatagggcagaatgcggcttaccatattggaggtagtcaccgacaagcacgcgtcagccgcttcggcagtcgagacgccgagctgctgcgccacggaggagtaagcagaagcggcgcgatcgacatcgaggcgcatcgcgcccccgaggaaattctcggcgttcagataaccgcacaggaggtaggcatccgtaaccgtcggcatgtcgccgccgcgggcaaatgcagccggtccaggaaaagcgccggcactctccggaccgactcgcaatgcaggaccattcaaccgcaccagagaaccgccgccggcgccgatcgcttcaatttcggtaacgggcagggtgatcgggaaatcgccgaccgcgccttgtgccgttaccgttggttggccctggcggaccaaagagacgtccgtacttgtgccgcccatgtcgaaggtcagcatatattcatgcttattggtgctggcgatggtttgggcggcggtgatgccggaagcaggaccggacaatagggtatgcaccggaaagttcatggcgtcggcgaggccaagcgcgccgccgtttgaccgtgtcacgtagaggcgcgccgaagtcaggcgcgagttcacatactgctcaatgtcgtggagataggactttacacgcggcttgacgtagacgttcagggttgcgttgaccgcacgctcgtattcgcccatgcgaggccagatgtcgctcgatatgcagacatcgatttcaggtgccgccgccgtgatgatgtcgcggacctttcgctcatgtgtaggatcgcggaagctgtgcaggaggactactgctatggaggacacaccttcggcgcgaaccgcggctacggccttcctgactgcgccttcgtctaccacggtcaacacctcggcatccgcgctcaatcgttcgggaacctcgaagaccaggtttctgggcaccagcggcagggcgcgcgatgaaaagagatcgatcgggttcttcagacgcagtcgctgcagctcaaggatgtccctgaagccttccgttacgaatagcgctaccggttcagccgagcgttcgatcacagtgttcgtgctgaccgtcgttccgtgcatgacgatgacttcgtcgccatcctcaacctcaagcgcctccagtagcggctcgaaaccgttttggaaaccctgtgcgaaattcggtggagtagagggcaccttcaggcgcttgatcccttttccggaatccgctcgccatcctacgaagtcggtgaaggtgccaccaatatccacgccaatcctaaccagtgccatcgaatatttcccatttcctcacttgtctgaaggcaaaacgatacctgcatggcccgtggggccacgtcggcaagtcatctgcattcagcgtttgatgagctatcttgagacagagcatcagagttgcgtagtgcagttttattaaattgggtgcatagtttttttgaagtggatgccgcctcggattcttggcggcacttcttgtcacaaaaaacagcgccacagggcgctgcttgttccttatcgttcgaagtcgccgcttatggaccgacgggaagcgtattcggtttgaagcggacgacgaaccggtgacggtcgccagggtagatcaggcgcacgaatgtgattaagtcgccctccagccaagtccggcgcgcaatcgaaatgcaggccgtgcgctcgaccacctgtagcctcctcgccaggatcgtatcagccgacacggcgcggattgaatgctcgccttcagtaaaagggatgttctgaagcagccagcttccaggcggttcgtctttgaactgttggcgttcggcctgtggaacggcgtcaagattgatctgccgcgtttccattgtgaacggaagattgtcggcatagtgcataacttcgagggttaggagccgtgtgccaaccgggactcctacatgccgcgcatcgagcgcgtcggtggcctttcggatgctgcgatcggtaatctcgaacgtataggtcctgtcgattgccagcacttctgcgcggatatcctgaatatgcatcagcggctcttcaatacgcggcggcgcgacgaaggagccggagcggcgctttctcgaaatcatgcccgaggctgcaaggctcgacagggccttgttcaccgtcatgcgggaacaattgtaaatatcaaccaactcgcgctcaggcgggatgcggaagccggagccccactcgccagtggctatcttgttttcgatgtcacgctgaatctccagataacgcgacgacgcctgtttgtctgtcgcgacttcatccattgctggtcgattcattgttaaggaagcgagcatcagtcaccagtcgtacctctttcacctgtattacaaaccttttattggtctataacatatggtgctttggccgtataccaaccgtgctcatcgcaacagctcaataaactttctgaacgtcgggaagggaacgcagggagccgccccttcccggcttattcagtcgaatattagagcaacggcaaaacatccttcgaaacgggcgttgccaggcggccggtcgcaacgagctccgtcgcgcgcttgaggtcttcggccatgtatcggtcgtcttcgagtttcggcacggcggtgcgaataaccttgcgaactgcatcgagctccgaactggaggtgagtggcgttctcaagtcaataccctgggctgcgctcagcgcctcgatgcccacaatcgaaaagagattgtcggtcatctgcaggagacgccgcgcgccatggcaggccatcgacacgtggtcttcctggttagccgaggtaggggtcgagtcgacagatgccggatgcgacatctgcttgttctctgacatcagcgcggccgaggttacctccgcgatcatgaaacccgagttgaggcccggcttcggcgtaagaaacgccggcaggccatagctcaggaccggatcgacaagcagcgcaatgcggcgctgagcgatcgcgccgatctcgcagacggcgattgcaatctggtccgccgcaaatgctactggctcggcgtggaagttgccaccggatacgatcgtgccgtcggacaggacgagcgggttgtccgtcgcggcattggcttcgatcatcaacgtggcggcggcttgacgtagcagatcgaggcaggcgccggcgacctgaggctggcagcgaaggcaatacggatcttgtacccgctcatccccctcttcatggctagcgcggatttcggaacccgccaacagcctgctcagcgcgctggccacgtcgatctggccctggtggccgcgcagggtgtggatttctggatggaacggcgcagtggaacccattgcggcgtccgtcgatagcgcgccggaaatgagggatgaaatgagagctcggtgggcgcgaaagaggccggccaatgccagcgccgtcgaggtttgggtgccattgatcatggcaagaccttctttggccttcaagacgataggggtgaggcccgcctttgccaatgcctctttggctggcatgacctcaccgtcgaacttcgcctgaccttcgccgatcagcgccgcagtcatatgggcgagcggagcaaggtcaccggaggctccgaccgaacctttctccggaataatagggagaacattcttttcgagcatcgcggagagaacgtttatgacctgtggtcgcacacctgatgcacccctgccgagcgagatcaacttcagcgtcatgatgaggcgaacgataccgtccgggagtggcgctccaaccccacagcaatgtgacaggatcagattgcgctggagggtttcaacgtcgtcggcgggaatgcgcacactcgccagtttgccgaaaccggtattgatgccgtagtgagcgatatctcccccagcgatctcggcgaccttgtcggcggatatctgcactctcttcagcgccgcggcatcgatcacgggtgcgagcgtgccatcataaacggcagccagggtttccaatgagacttttccgggaacgagcgcgtgggccatgtttagaaccttttagggggacaggagatccagaggcatacataatagccatgcgtcctctattttgtatataccaatacgaaaatggaccaaatgtaaagcgccgcgcagcaaaaatacgaacagcggctctaaagaggtgccgctctaatgccgtcgtggtggcaacggattgattatgttcactgaaccggattgaaacgaccgtgaaactcttgcccgttgacggctcgcccgtagaacattcctagataccacgggaagtaatggtaggaccacgcgcataggcgattgccatacataatgaaggtgcggagcagtgttttgagttcttccttgtcgtccgtctgcttcatcgccatacgaagtttgttcgagaaatccagcagcgtgttaagaccggaatagccgagatactccgaatacgcgggatcgaatgcttcaacggcggccacaaagtcgtcgtgcgagagcgtatcgataagtttgaggagcgggtaggcggtgtacatgatatagtcgcggagcatgccgttggcgaagtcccaggcagtgaaaaactgaccgtaggtcccggtatcgccgatctgtcccgttcggatcttacgcagatcctccggctctaccgtctggatgcgcttggcttcggcgtagaactcggctgcgacgcccttgaggtttccgaagcggccctgtccattgaaggcttccgcgggatcgtgtggccttacctctacgaagatcctctccttcgcgaagaacagattgttccagatggctttgccgacgatgggaagcagatggtggtattccggacgtacctgtcccagcaccggctgcgccaggggctcaaggcccttgccatactgaatggaaaacttattgccggtcgcctgggagtatctcagatccccaacggcacaatcgacgatccgccgacgcagccgcaccggcgcggtgctgatcgtcggcgtccaagcatataaggactcgccggaaacgacgggatgagcctgcatcaccttgaatggcaggtcctgccaaaattcctcgcacaattcagggttatcatcatccgccaattcagccacgaccgtgatctgaagttccggccacgcgatatcgatcaatcttcccattttcagcgcgctccgaagaaaaattcgagccagtgagaccgcgccccgaataggtatataccatagaggttgctcggctggtcgcaacgacgaaatcgccttaatcggcgctgagcgaaagaaaattcccatacaaaaaggcgtatttgtctatttttgtgcaattttggaatgatgttagaggaatatttcagtttccggatcgaggcgcggtcgttttctggcccgtcaagccgttagtttttgggctaaacgtatattttcctaagcggtatgccggacgaaaatattaaatggtctatacaaaacggagtttatggctatgctaatccgagtggaggtcacctgccacgcacaagatcaaccataggattctgagaaatgtcgtttaacagcttgagtgacgtcgttaaggcggtgaaggaaaagacggctgcttatgaaagcaccgagccgaaggagcttcatgatatccggaccggcaccttcgcggtcgggacaaacaaccaatacttcacgaacctcgacttcgtgaacggcatgctgcgcgaccagtcgatgtacacgtggtatccgttgctgctgacgttccaggatgagcgatttaccctcgagcagtgctgcgcactcgtgcaccgctttgactacgcatacagcaactatctgcgctacagcggcttgcaggaaatgggcgcttttgccgaagcgatcaccaaatatcttccgacggctggtagccgcgacgaggcggttgaggccgtcaaggcgttcctgggttacctcaaccgtttggccgcctggtcattccattacttcccttggagcatcggaaaacatctcacttacgagaccccggaaggttccatcgcggccctggccgatccctctcggcgtgttcagatccgcgacggtcaaaaggtacggcttacctgggagccgctgggcatcagcgtcattgcctatctcgcgacgaaggaaaaccccgaactctgcaacgaccttattcaagctctgcccttcacggttgttcaggaccatgccgttgtcagcggtgaatccatgtacgcgtgggcgcctgtcgtgagcaccgcaaaggttaacgtcaaggaacggcagtgcgatgctccggtcggccgtatccgctattcccagggcaccggcaacaaggtcatcgtccagtatggtgaagtcaccgaagatattgcgacaccggttctcggtgagatcctgccggagtatgccgacgatatctataaggttggtcgcgctgttctggaaagcaactttggcgacaagaagccgatcatgctcacgatcgaactcgcataacaagcgttcagccggggcggtttctaacgcgagccgcctccctttggcgacaaaaaaattgacttgattggctaagcctttctgttaatatgtatagaccaaaccgcaggaaacatgcggtaacaggagaacggcgaaatggcattctggtttgaattcgacaaaatcagtgaccttccgaacaatgcgggacacagcgtcctggatgacggaagttcgttctgtttcagccatgtaaccgacttgacgacgcgtttctttaggggcggattggcgtggctatctggcatgcaactgccaaacatatcgccccgatgacgctgagccttagctcctccgaggacagatcccagcggaaaagaagcggcatttgtatatgagatgatgagcctcaagcaacggaggcaaatctcaaacctgaagtcaactcaatgtttgcggtagggcacggtgtccgacgcagaacggtttgtctcgcgttgctgcgagccaaaccccaaccaaggggaactaaccatgaaatggcaatttgggaaagccatcgtcggtggcgcaatgttggtcgcagcttgcgcgctgagttcaggagctcaggcgcaacaaaaggagctgatcgtcagcggttttggcggtgcctatgacgaagcaatggctgcgagcgtgaaatccttcgaacaggaaaacgacgtcaaggtcaccattgttgccgggtccggcgcgaacaacatagcccgtgtccgcaacaaggaagtcgacgttatcgtttctgatccggttttcgcgcttcgcatggaagccgagaaggcgtttgcgccgctcgatccgaagctggttaccaacctgaaggacattcacccgaatgcgatctactccgacgcggtcgtcgcagcgaatttcggcgcatatgtgctcgcttacaatcctgcggaggtgaagccgccgcaatcgtggcatgatctcgcgaagccggaatacaagggccgcatcgcgctgcgcggattccggcctgaaaatatcgatctaatcactctctttgcgaaagaggccggcggcgacgagcgtcatcccgacgccggcttcgccgaaatggccaagatcgctcagaacatcgacgtctgggtggactcgcacgccaaccatctcgaactgtatcgcaacgaccagatctccatgagcatgtggaccgatggccgcatcggctgggcgcgtgacactgaaggcgtaaaaatccagggcgtcattccgaaggaaggatttttcccgctcgcctcgacgcttagcgtcgttgccggacgtccgaacaccgagttggccgagaagctggtcaaccacttactgagccccgcctcgggactcaatatggccactcgccttggttatttcccgacgaaccgcgaagctaagctgccgcaggaagtccaggcaaagatcatgatcacgccagacaacgtcaaggatctgaaaagcgccgactggaagtacatcgtttcggtctatgatcaatggcagcagcgctgggaacgggaaattcaacgataatgacccaaagtttcgacattgaactgtcgcactgccgcaagacgtacggcgacatcaacgttctggacgacgtctcccttcaggtcaagaacggtgagttcatcaccgttctcggcccaagtggttgcggcaagacaacgacattgcgtgtgatcgggggcttcatcattcccgacagcgggcgtgtttcgatcagaggcagggaggttaccaacctgcctccctacaaacgcaacatcggcgtggtcttccaaaactacgccctgtggccccacatgactgtggcagaaatcctctcgttcggtcttcgcatacgcaagctgccccgggaagagatcgcgcgtcgtgtagaccgtgccctcagcatggtgcaattgaccggcttgaaggatcgatatcctcgtgaactcagtggcgggcagcagcaacgcgtcgccatggcacgagcgcttgcgatcgatcctgaggtgatcattcttgatgagccgctgtccaatctggatcggcgcttgcgggaagaactccgtattgaattgaagcgactgcagcggtctcttggggtgacgatgctattcgtcacgcacgatcaggaggaggcgctctccatgtccgaccaagtggtggtcatgcaatccggaaggattcagcaaatcgccgacccgaggacagtctatgagcgcccggcgaaccgttttgttgccggctttcttggtagcgcaaatttcctgcccggagaactggtgcagaattccaaggagagcagggccgaaatcaagctcagcaatggcgccgtcgtgactgcgcatgcgccgtcggccagggcggtcggagagaaggtcaccgttattgttcggcccgagtggctggtacttgaacggcagggcagcaatccgcctgcaaatcagctcgagggcacggtcggcgatgtgatctatgaaggctctgcaattcgatatgggatcaaactcactcacgaacctgaggcgcccgttttcctgcaggaacggtctaacgccgatgttttgaaacccggagacaaggtcaggatcaatgtcactaacgccgtcgttgccgcagagtgatgaacgcagaggactttgggagcgtgtggttgcgtggtctacccaagcgccgctgttcctgccgttcgccttcgtcatcttgttctttttcgttcccatgtgctggctcgttgcgacgagcatgtcctcccatgaggttggcagcgcgcctgtatttacaggcacgctagagcactacgcgaggttctggacggaccccttctatctcgaaacagcgctctggacgaccgttaagctgtcggttttgtccacggtgcttgctctgattatcgggtatgtgctggcctactacattgccgagctccctgctgaccgcagagggtttctcaccagcatggtggttgtgtccctctctgtgaacatcgttatccggatctttggattgaatgttcttctaatgagcggcggacttattgatagcgccctgaccttcatggggatgccgaaggtccgcatcatgtataccgagcttggggttttgatagggttggttcagatcgccatcccgtatgtcgttttgcctcttatcggtgtcatagccgcgatcgacccggccctcaaagaggcggcggcaagcgtgggcgccaacaagtacaagaccttttgggccgtaaccttcccgctgtcgctgcccggagtcgtggcgggcacactgattgcgttcactttgaacgccgcagcttttgcgattccgtccctcatgggcggcggtcgggtcaaaatgatgggcatgatggcctacgaacaagccaccgtgcaggggaacttccccttcgcagcggcgatcggcataagcctgacgattctgagcatcctgattactgcaatctatttgtttgccatcaatcaaacattccgcacggcgaggagagcagcatgagcgctaccacaactgtctcgacggggaagggcgtttcggccaggaaggtgtggttgccactccccacaggattaggtattgccgctttctgcgcgttcgtcaccgtcgtggcgccactgtttgtggtcgccggcgcagctttgaacgcggaagccatgttctttccgcccaagcaattgacgttgcattggatgattgcggctctcacggacagaagcttcgtgaatggcgccctcatcagctttgccgtcgcagcagtagcagccacggtctcaacgatcttcgcacttccggtcgcgctccaattgcggaaagcaccgcccacggtggcgaaggtcctgactttgtcgttcatggggccgttgctcgtaccctcggtgatctttgctctgtcgttgtattcggtgatgatctacgctttcggggtgacgaacctatttgcgctcgtcatcggccacgtgatgatcaccatgccatacccggtacgaacgatcacagccgttaccgagaacctcgaccccgcgctggaggatgctgcaagcagtgtcggcgcaaatccgtggcgtacgtttgtgtcagtaacgttgccgttgatcaaacctggtgtgatcgctggctttctctttgctttcataacctcgtggaatgacttctccatctcggtcttcctcacgccgcgcgaactgcagccactgccgatcaaaatctatgagtatctcctctaccaatacaggccattgatagccgcagttgccacctggtcggtgattggttcggccatcgtcgttctcataatcgaccgtctggtggggctgaacgtctttaccggtcgtcgcggctagtacagtagatatgatcacatctgaaatttaattttaagaaggggcgctcggcgcccctttttgcatgccagtttattccccgacgcctcgaaattacgccaacgcaaaacaggcgaccttgcaaggacaagaccgccaactcgcctccgcgtgtcgatcagcggcgaaccaacttctgcattgtggtgaggaagcgtcgattgatcttgtctcgggcgacgtggcgaccggctaccacttgtctgcggccttgaacccaaacgttgtcgatcgcaaccccatctgcaaagatccaatgatccaggatctcgtcatcttcgagatagggaacttctgtgagattgagtgaaagcatgtcggcagaattgtgtacctcaatgccactctccgcgttcagcgccatggcgccgccgcggacggcagagacgataagattgcgacccgttgagccgcccggcgctgccaggacgttacgtgcttggagtcgcagtcgttgtgaatattcaagttgccgcagctctccgttcagggaaatgagaacgttcgagtcggaaccaatgccgacacggcctccttgttcgcagaaaatttggcctggaaaaataccgtcgccaagattggcctcggtaatcgggcaaagcccagcgatagcgccagtccgcgccattcttgccgtttcgatttcggtcatatgagttgcgtgaattaggcaccagcgctggtccacaggtgcattgtccaacaaccattcaacaggacgagcagaggaccaggcaatacaatccgaaacttccttcatctgctcggcgatatggatatggattggccctccgccagacattgaggtgaccgcaagcagttcctgcggtatgacggctctcaggctgtgtggtgcgacaccaagctcggcgccgtcgattttcgcgactagagatcggcacgcaaccattagtcgttcgaagctgtcgagcgaattgataaatcgtcgttgcccctccaccggttcgagtccgccgaaatccgagtgggcgtaaaagacaggtagcagggtcaagtttattccggtggcactcgcggccgctgcgactcgttccgccatttccgcaatgttggagtaatggtttccatccgggctatgatgcaggtagtgaaactcgccgacacggctgaaacctgcttcaagcatttccatgtagagctgggacgcaacagcctcgacatcgtcggggctcatcgtcaaggcgaaccggtacattacatttcgccagctccagaagctgtcatctgacggcccgcgggtctcggccagacctgccattgcgcgctgaaaggcgtggctatggagattgcccatcgcaggcagaatgatttgatggtgttcgtcggatggtgcaggatcagcatcggtcgataccgacgcgatggttccgctctcgaccaacaccctgacattgtcgtgccagccgctcggaagaagggccttccgtgcgaaaagtgctgaactgttcaattccttcatagcttccctctgattttttgcgaaacgcaggcaactttggtgcttgcaattccgtgtattggtatatacaaaatatcagtaatgaaagacaaatatagagcaacggggatcgagatgtcagtggcaacgcccgcatccgatgaggaaatcgtcgtttggaggaacgcgcatctggcgactgtcgcgggagatcgagacggcctgggtgtcgtagagggtggcgcgatagtggtcagaggtgaccgcatcgcatacgtcggaaccgacgcaaatctcccggcgttggcgagaggcgcggttcaagtcgatttggagggccggtgggtgacgccggcattgatcgactgccatacgcacttggtattcggtggcgaccgcgcacacgaattcgaaatgcgactcgccggtgcgtcgtgtgaggagatcgcactggccggtgggggaattgcttcttctgtaaacgccacgaacaaattttacgaggatgaactcgttttgcaagatctgcctcgacttgacgccctcatggaagagagactgtcgacggtcgagataaagtctggctacggcctcaacgtcgaagctgaattgaaaatgctgcgtgtggcaaggggattggagacgctgagaccggtgcgcgtcgtgaccacttatctcgccgcccatgcgatcccgtcaagttacagaggcaggaatggcgactacatcaaggatgtcgtcatccctggactcgagcggggcaggagggaaggtctcatcgatgcggtggatggtttttgtgaaaatatcgcattttcgccagcggagatatccaaggtattcgacaaggcgactgcgataggccttccggtaaagttgcacgcggagcagctatccgatcttggaggagcaaagctagccgcgtcctatcgagcgctctcggcagatcatcttgagtgcctcgatgaagaaggtgcccaagcgctcgctatggctggtacggtggctgttcttctgccaggagcattctatacactccgagaaaagcagctgccgccagtgcaagcgcttcgcaatgccggcacgcctatcgctatcgcaacagactgcaatccgggcacttcaccacggacctcgttgctgctgactatgaatatggcagccacgttgttcggcttgacggtcgacgagtgcgtcgctggcgcgacaagagaggctgcacgtgcccttggtctcttgcatgaaactggaaccctcgaggtcggaaggtccgctgatttcgcgatctggaatatcggacggccagctgagctggtctagcggatgggcttcaatcccctgcatgcgcgaatatttaagggacgaggactgcggccgtgactttaagtcatgtccctggcgtttcgaacctggctggttctttcacctccattcgctagtcgtagaagagaagaaatcatgagtgtttttgaagttcgccacggcacctctccggttattctagcaatgccccataccggtaccgatgttccgagcgagatctgggagcggttgaacgacaatggccggcagctgatcgataccgattggtatatacataatctgtacgatggtcttttagagaaagccacagtcgttcgagcgatgtttcatcgctacgtcattgatgccaaccgggatccggaaggggcgagtttgtaccctgggcagaacaccactggccttatccccaaaacggactttgatggtgaagccatctggaaatccggtgcggaaccgacagacgacgatatcgctcaacgagtcgctactttccactcaccctaccataccgccctccaatcagagatcgagcgggtgaaggcaattcacggcttggccattgtctatgactgtcactcaatccgctcgcacattcccttcctgttcgagggaacgttgcccgacttcaatatcgggaccaatgacgggcagtcgtgtcatcccgcagtcgcggcggccgtcgttaacgtcgttcgcaatgctgatggctacacacgcacgttgaacggtcggttcaagggagggtggaccacaaggcattacggcacgctcgaaagcggcgtccacgcgatccaaatggaactggcgcaatcgactcatctttcggcagaggaaccgccattttcctatgacaccgcaaaagccgagcgcatccgcgcccgtctcagggacattctgaccaacctcgagcgcgccgcatccgaactcaagaagtgaatattgggagccactgaccatgaccaatcctcgacacaatatccgcgaagttcgcgcgccacgcggctcggagctcaacaccaagagctggatgaccgaagcgccgctgcgcatgctgatgaacaacctcgatcctgatgtggctgaaaacccccacgagctggtggtttatggcggcatcggccgggcggcacgcacctggaacgacttcgaaacgattgcggcgacgctgaagacgctcaatgcggatgagaccctgctcgttcagtcgggcaagccggtcggtgtcttccggacccacaaggatgcgccgcgcgtcctgatcgccaactcgaacctcgtgccgcactgggcaacctgggaccatttcaacgagctggataagaagggccttgccatgtacggccagatgacggccggctcgtggatctatatcggcacgcagggcatcgtgcagggcacctacgaaaccttcgtcgaggccggccgccagcattacggcggcaatctcaaaggcaaatggatcctgaccggcggtctcggcggcatgggcggcgcccagccgctcgccgccgtcatggcaggtgcctgctgcctggccgtcgaaagcgatgagacccgcatcgatttccgtcttcgcacccgctatgtcgacgagaaggcaaggacgctcgacgaggccctcgagatgatccagcgctggaccaaagccggcgaggcaaaatccgtcggcctgctgggcaatgccgcggaaattttccccgagctcgtgcggcgtatggaggccggtggtccacgccccgacatcgtcaccgatcagacctcggcccatgatccgctcaacggttatctgccaatcggctggaccgttgcccagcacaaggccaagcgcgaaagcgacccgaagaccgtcgaggctgccgcccgcgcctcgatgaaagtccatgtcgaagccatggttgccttctgggatgccggggtgccgacgctcgactacggcaacaacatccgccaggtcgcaaaggaggaaggtcttgagaacgccttcgccttcccgggtttcgttccggcctatatccgcccgctcttctgccgcggcatcggtccgttccgctgggccgccctttccggcgatccggaggacatctacaagaccgacgccaaggtcaaggacctgctgcccgacaacaggcacctgcacaactggcttgacatggcccgcgaacgcatcgccttccagggcctgccggctcgcatctgctgggtcggcctcgccgaccgtcatcgcctggcgctggccttcaatgagatggtcaagaacggcgagctttcggcacccgtggtcatcggtcgcgaccatctcgactccggatcggtcgcctcgcccaaccgcgagaccgaagcgatgaaggacggctctgacgccgtctccgactggccgctgctcaacgcactgctcaacaccgcatcgggggctacctgggtgtcgctacaccatggcggcggcgttggcatgggctttagccagcattcgggcgttgtcatctgcgccgacggctccgacgatgccgccaagcggctggagcgcgttctctggaacgacccggcgaccggagtcatgcgccacgccgatgcgggctacgagatcgccatcgactgcgccaaggacaaaggcctgcgtctgccgggcattctcgggaactgaagcaaatgcgcgttctgcgttccgcgcagtacaagcgcacgatgtggaagaacggcaagggagagacggtggagatcgccgtctcccctccggatgcgtcggtcgacgatttcgactggcgcatcagcaccgcgacggtcgctctcgatgggcctttctcgacattcgatgaagtcgatcggacgttgagcgtgctgacgggggaggggatagaactcgcgattgccggggagcccgccaccgtctgctctcagaatagtccgccttttacctttcgagcggacgtcccgaccaccgctcgactggtggatggccctatcagcgacctcaatgtcatgagccggaggggacgcttcggtcatcgcgttgcgaggtgcaggcttgatggcgaattggaggtcggatcggatgtcgcggtggtgttcgtcatcgtgatgtccggctgcgcgctaaagaattccggggagcgactggaaagcctcgatgcccttcacctggatcgcgccgaaaaagtcgttcttcgggcaaacggcccgacgacggcgttcgtcgtcgagttgctgccactttgaacgggaaaatgaacaccctgaggataccaagttgaacaggcaaaatatcgagaacaggcaagccgaggcggtcaacctggttgagaactacgggccgattggcattcgttctgtcgctgccgcatgtgcagcgaggcctcctcaaaaagaactggatgagtcgtcgtcaatcgagtttccagcggtgcgcgcccgctggctcggtgacggggatgattgagtttgaaggtcggcgatgtggtcatggagtttgtgttgcccggtccattagaactagcatgccttcggtggctgtctcgcggcaaaacgctcgccgaaatcgctctgcttcaaggcaaaaccgtctctgaaattgcgcatcatgtcgaacgcgcgcttgccgcgcttaacgcaaaatcggcacaggaagcactcgcaaaagctcacctttcgaacggcaactgatctgaaacagaggctcgttcggttggcctgcatcaggagtgttttcccctcgtagggcgaaactacatgtcgacggatttcaatgctgagctccatgcccggccgtctatctacttcaccggtccggccttcgttgagcatgttgcggtcatgcgctccggtccgattacgcaggatggtgcgcgcggcatatccaccgacccgtgtcacagtgagaatttgcgcacgcaggtggaacatcatacggaattcgtcaccgtacgcgcgtgtcgaaaatcagcgaggaggcggcgtcctggcccacttccagtctcagcctttccgaaatcgcggctttagtggacataagctcgccgcagcttatctgtcggatcggcatcctgatactgggtactgccccaaaggaactcgggcctgtgctgtcgagtctcgggtttcgcgataccgcagcgtcgtcgatcggcggcggtgcggcgcaggtgtgttcggatttccgcgttcagccggaccaaacgagccgcgtccttctcttcaacaaggacctgaacgcctacagaaaggtgcggtggaaaatgccaacaagcgcattcgccgcttcatgccaggtgataccgatcttgcagccgtctctcagcgcgacctgacccaccttgcccgccatctcaaggatcaaccgcgaaaatgcctcggataaaaaaccccagcagaagtgttcatggcacatttgcaggaagaggggtgatcccctaccctagacgccggcatgatgcacttgggttagcttttccaaaacaatccgtgattttgcatctggttaaactggtccaggatgtttagtgacacctggcccggccgtatacgagccttcatccgtgagacatatcaaccacgacgtccaaagctggaaatattaaaggtcaccggtgctgaaccgcggtatcggaaaacgcttgggcgatgaggaaaagcgagcgaactccgattgttttatccagtgaccaaatcggcgcgctggtacgaggaaagcatcgtttgaacgatacgcatgccatcggacttcaggtcaaacctcgaatcatcctccagccaggtctgaaacgttcctcgcattgcaaaccaaaaggtatatgccgcagtgtcggaggtccaaggagctagtaattcctttctcgtctctgcggatccgaaaacgctccctaacgtagcccgcacttcctgctgaaacttgcggtcttcattatggaaggccactgtatcggagactttcttatcatagatctggaaaatccgcctgcagttttcattgtcagcaaagtggttaatggctgatgtggcaaactcggcgactgcctttaatggctcctcaaccatccctgcgtcgtgaaggctgccgagctttcttgcctgccagcataactcatcgcgcaaggccagtagaatgtgcatttttttgtccgaaatgccactggatggcgccggttgttacggccgcttcggcggcaatttcctgcaaggaggcttcatcgtatcctttttcgataaacacagcctcggcagagcgtaaaatccgcctccgggtagctgcagcctcatccgacgtccttctcatgcatcgcccccctgtggcctatcgcatcagtcctcttgatgaacgtttttcagcccgacattccgcgagaaacaagaaatatgaaatcggctacggtttgccacagcaatttcgttacaaaataaacagagccaacacaggggggaccagcgctcgtagtgccatctcgctttttggacaacacgtttcaggtaacctgcaaagcgcgcagttagcgtcggagtagcctaaaatcgctctcttctgaacgtaactttcaagtggcactatcttttgccatggcagaaatgagcacctcggcgtcctcttcgacgaggaggatgttgcgatgacttgctgtcaagaatgcttcgccaacaatatgatcaagaaaggaatctagccttttgtaaaagcccgctacgtccagcagtgcacagggcttattgtggtaacccaactgagcccatgtccatacttcgaacagctcttcgagggttcccaatcctcctggtaaagcgataaaaccatccggcagcgtcgtcatcagcgctttgcgctcgtgcatggtctcgacaacgcgtagatcagcaagatcggtgtgtgcgatctccttctcggccagcgcgcggggaatgacgccgataacctctccgccatcgcttcgggccgcgtccgcaatagcacccattaaaccaatcgaagcgccgccgtacaccaatccgatgcccgatctcgccagagctttgccaagttggtttgctgcgctcacataggccggattttggccgttgcttgaacccgcaaagacgcaatatctcaaacgctcctccaattgagaaaacgaacttcttgaaggccagctatttcccgaattgagaaactccctacgagctccacgcccgggagcggcttagctaagaaaccttaagttgaacgtcaatcttcgttctggcagcttttggtagccgccgctcctccgctacgggccattgcgatgggttcgcaccaagtggtgcgagcaggtcgacttgtgcacgacaccatggtgacaccaacaagcgctcagcctgtacgctttcgaaaaaccattgccaatgcacccattcccacgctgacacctcattcaaatcggggttgacgccggaggttttgcaatgtgcagcgaatacggggcacaactcgttttcggtgatcccattcgtcattgaagcgcgataggaaaattccggcagcacaagacgaatgtcgtctgcacgtatccgcaattcctcgtgaccccggcgctcgatagcctcggtcaacggttcgccaggttgcgggtgtccacagcaactgttggaaagaacaccgggccaggtgatcttatcagatgcccggcgcgtcactagcagcttgttgtcaccgttgaaaatgtagaccgaaaaggccaaatgcagtggggtatcggaatgatgaatctcggattttggagcagtgccggtggcctccccgagttcgttgcacaatatgaccattcaggcgattgattggccggtagggtcatcacaaatctcttcgtttcgcgacgttaacttccgacactcagttagcgtttgatgccacccgaggagtgaggcgaacgtttccgccctcctgccaatcagggaagtcgcgctcctgccactgcgcatgatcaaaatattcgtcggcgatggccgagatcagcgcctgctgtcgcgtcaaatcgagacgcaacaaatcgcgaatcccgatatcatgttccttggcgaaccggattgcgcagcgatacccgtcgatgtcctccagtatcggccggagcgcctcctgcttccagagatccgtcagttcctgcagcagagatcggcgctcgtccttgacagcaaacatttccgtcacccggcgtcttgctcgcggcaggaaaacatctggagccgcaagacgaagtcgccttacatgccatctaaaatcggcttcccaataagtgtccgtggccatacagttcagaagggaaatcgaaccgccttcgaggatgagaccaggagaggtccggcgattctctacttctgagatgagctgacgatgagccgcctctgcatcgatcacaccctcagcgagtgggcgcgaatccaggtagattcgctcggtggattgcagttccgattccaaaggacgtccactgccggtagcgatttgggggcagcattgtacccgatcgagcgctattaccggccaacccgtttctcgggccacttgtactgccaagtcggtttttccgctacaggtgggtccatagataagatagataagcatgtgcatctcgcttctttcaaaaccagcgggggtgacgcgacacggtctcatgatcaagacgcttcattcggcattggctgcgccgcgcgcattgcaaaaagaacaaacgtcgaagtaaaagtgctaacgctttcgacgtatgatagtattggttcgtagaataactttatcaaaccgcattcagaatttgcaatatgagggaaaacattaaatttgtgctttaataatttatgagtactgatatttatgtcgaaattcaaattcccgcctttgacagtttggtttcatttgacatcaattcgcgtgctacggctcctggcggcagagccgcgcttgatgaataggtacacgtgtgctttttccggaatgacggcagcgcggttgtgattggccaggagctggcgaatgagcatggaaccagcaccggcctgagttcagtttagcgtcaagttcaggattgacggggagagctaaaagcacattggcgggcgatagtccgctttgaggcggcgccaggcaaacagatgcaaatcggccgtctgcgcgacgaacggcctactgctttcgatgttgacgggatcgttatagcactttcttttagaactcctgctttgccgccttcggcataagggagttcggatattgacgagtgcttcggcgacgacagcagcatccctgcctggtcgctttccgtttcgtgtcgccgagcgtgcggatcgcgcgatgacatcgccagtgacggcatgacctcaaagaacaggctgccaaagcctagtttagccgggcaactcagcaaaataccgccatggtcgaggaaaacaatgccccgaacccgacgcttgccggggaagtagctcggcctcgcaagctgatcagccgtttccacttcggcaggccatacgtcggccggtctctgatggaattggtcaccgaaccggcacatcgcatcgccgtccgccggatcccagcaatcctcgccaatgctttctccggcaacggaacctcaagcagatctggaaagagttccgaaaaggtgatcgacgttctcgcgacagagaacggatacagggacagcgagtggaagagggtgcgcgttacgcaccctcttttacttagagtccacgtccatccccgcggacgcggatgcgctcgtcaaaatcccgtgtcagccgatccacgtcatttgccgccttcggcgaagtctgttttggtgctgcattactctcttggacactctgcctcagactacctgtagtttcgtgcccttctttcgagactacatcaagttcttggggcttctcgcgattggtttttatccgatcgggcaaccgaatgatcgaggtctcgccaacgatagtagcttgaacctggggtatttcgggcgcttcggtgcgctcaatcggcttgacctcgccacgtgccgcgacaacttcctggcgttttgcaatccgatcgatggcggctgtgtagtccggcaaggctgggaatttgtcctggtagagctcgctgcccggctttcccagttgcctggccaagatgtccctgtcggcggtgtccttgagcgaagtgaaaagctgcgtccgctcgtcggccctgctcagcaaagcgctattggcgttgatgccatgggcagcgtcgttcaagagatagatttggtcaacacgtttgccgtcatcatgtcgcgtaagttcataggcggagccgatgaccgtcatcgggccttcgattttgtagcccttgacgcccctgtcacccggctcgccggtgctggcctcgaaggtcttgctctgactgctgccatcgggtttgaaggtaacggatttgccttcgatcttttcgatccggccggcttcaccggcaatgagattcctgtagctgctggtgacgctgagcctgtcgccgaccctgaaacggatatccttgttgttgaacgccttgaagctgacagggtcgccactcaggcgaccggatgcaaggccctgtttttcgatctccttggccagcgcatctacatcaacgcgccgattggcatagagcatgcggaccttttcgggatctgccttgatatccctttcgtaagcatccgccattgctttcagcgccgacccggcgtccgctttctcgacaagggagccggttgcggcgagcgtttccacgagcttcttgtgatcgccagcctgcagggcttccaccacagatttttgactgtcaggcgtccaatgtcccgcctcgtagggcgtttggttcaccggctccatttgaacagtaggactttcctcgccacgtccggccctaagttcctcgcgtttcgcgatccggtcgatcgcggctgcgtagtccggcgagactgggaatttgtcctgatagagctcgctgccaggcttgctgagttggctggccaagatgtgtctgtcagccgtgtcgctttgcacggtgaaaacctgggttcgttcgtcggccttgctcaacagggcgctcgcggcatttgagccgaaaatggcactgtgcaagacataaacctgatcgacgcgcctgccatcgtcgtgatttctgatttcgtaggcggagccgatgattgtcgtgggcccctcaatcttatagcccttgacacccctgtcacccggctcgccggtgctggcctcgaaggtcttgctctgactgctgccatcgggtttgaaggtaacggatttgccttcgatcttttcgatccggccggcttcaccggcaatgagattcctatagctgctagtgacgctgagcctgtcaccgaccctgaaacggatatccttgttgttaaacgccttgaagctgacagggtcgccactcaggcgaccggatgcaaggccctgcttttcgatctcttcggcaagcaaatctacatgatcacgtttgttggcgtagagagcgcggactttctcggggtccgcactaatgtctctttcataagtctgcgctatcgctttcaacgttgatacgagatttgtgttctcaacaagggagccggttgcggctagcgtttccacaagcttcttgtggtcgcctgcctgcaaggcctcgacgattcttttctggttattgactgccgcatcggcagcgtcgggcggcgtttggggcgccaggtctatcggggcggaagttttctcctcgccacgtgccgcgacaacttcctggcgttttgcaatccgatcgatggcggctgtgtagtccggcaaggctgggaatttgtcctggtagagctcgctgcccggctttcccagttgcctggccaagatgtccctgtcggcggtgtccttgagcgaagtgaaaagctgcgtccgctcgtcggccttgctcagcaaagcgctattggcgttgatgccatgggcagcgtcgttcaagagatagatttggtcaacacgtttgccgtcatcatgtcgcgtaagttcataggcggagccgatgaccgtcatcgggccttcgattttgtagcccttgacgcccctgtcacccggctcgccggtgctggcctcgaaggtcttgctctgactgctgccatcgggtttgaaggtaacggatttgccttcgatcttttcgatccggccggcttcaccggcaatgagattcctgtagctgctggtgacgctgagcctgtcgccgaccctgaaacggatatccttgttgttgaacgccttgaagctgacagggtcgccactcaggcgaccggatgcaaggccctgtttttcgatctccttggccagcgcatctacatcaacgcgccgattggcatagagcatgcggaccttttcgggatctgccttgatatccctttcgtaagcatccgccattgctttcagcgccgacccggcgtccgccttctcgacaagggagccggttgcggcgagcgtttccacgagcttcttgtgatcgccagcctgcagggcttccacaatggaagtctgcgaaaaatgacgctcgctgcctgcagagtcagcgccttgcattttctggtcattcgaagccatatttttttctcctgagtctttggtcgatcgtttctctgagacgtttgagggggcgttcgttgacgacaattcccaatttgatcccggatcatcttcccggtgcggtattggacccactcggccatcagtaccgatgatatgatcgacgtccgcatacgtcggttgaactgtgttggtgaccgaggttgccagtttcaatcgttcgaacagggaagtgatatcttcaacttcctcggcagaactaactgagtgacgggccatttttttgcgagaatcgatttcttcctttgccgccgctcgtttccgtttctcgatcgctatccccaggtttgttaccgttgcgatcgtgacttggtggctttcgtgggctgaggtgttagccgtcgattccgacccgcagaattccggttgcatttgctcttcagtcgtgatgacagaagactggaaaacttcgaagtcaatggcgctcgggtaaaggtccgcgctttccggcatttccacatccgatgtggatggttcgtgcagctggttctccccgaaggagctttcttgtctgccttggaaggaaagcggcgtcgttggagagatttccatctggtcgagcggccttagcaagtgcgcgttcgaaaccgacgagcgctcttggaaggcagcaggttcgagcgctgggaattgaatggaattatttggcgcgctttgctgagtgagctttgcactgagagcctcaacattgtttgccacgaggggagaagcaatgacgtcgagacgactgcgatgcctcgtcaggccgacataggtcagcttatctgaaagagcaccatcacagaggagaatggcgtgatcaactgtggccccctgactcttataaattgtagcagcatagccgtaggtaaaacccttaaactcgctatcggtccaagtgacggttcgtccagatccgtctaaccttgcagtaatgcgaaccccagcagatgtgccattctcagctcgggaagcttctgtgctattaagtccgactacagttgcaaaagtaccattgcggatgtccgcttgcagacggttttcgctgaatataatcctgtctcccaagacgagattaatcctttgctgaacgcgtctcgacgaaccctcatctattccagattccgaacttccactatctattacgcttgaccacacactcatttgctggtcttgcaatccggatttgtcaacaaacctctgatgaagagcgatattggcgcgattaacgctcctgttggagtgtgccatcacaagacgatcatacaccggatatcggtcgcaaactctattcatctcctccagcatgcggtcagtgatctggtctgacgccctgacgtttgagccgctaggaggagcatatacgaaatggacgaggcccatttgttcgagcgctgtgagatagtgcccgacggcgctcttggcatcgcgtcgtatgtcacgtccgagcttttctgtttctattcgcgaccgcgcgtcgagctgtcgaagcggctggacgagttcatagcagccggcttgctccataataatcggaagcagatcaccaggtccaacagggggcagttgccgatcgtctcccacacatatcagtttcggcctttcggttgggtgataggaagtggcatttgcaactgtctcgattagttgcgcgatctcctgcgtcttggccatcgacatttcgtcgatcacgacgatggtattttttccgatggtgcggtctttcgccttgaaagtcgtcgcgacgtcgcgaagacctttctcacgaagctcctgggccgcccggttggtgggtacgaaggcaatcaactttattttctcggtcgggagcgcttcctcgttgaacctgtccaccgcttcgttcagggctccaagtacacttgtttttgcggaacccgctacgcccaccatagtggaagctcgatttcgcctagacagataatgtaatgctcctctgagctccggtgtgaaaatgcctctatcggcgaccatatcaacaatggttcccggaacgccgaagctttcttctgcggaaagattggtgacatgacgtacagtattctgttccgcagctctcagctctgtagaggtgtagagaggttggccatctggagaatcaagccgggtcagtttgtcgcttgcgacgacctgttggaatagcaggtcgatttcttgtaccggccgtttgtagtgcgtgagtgcccgagccgccgaaatcttaagttggtcttgtccgaagcacgcattgcgatttgcggcgtggtttacgacccattccacaatattgctctcgtccagcaggttactgaactggcgaagatctgtctggaagcgcgtagggacagacgtgtcaacagcagccattccgggatcggacattacaatgtcgtcggttggcatgcttgccactcctattcccctcgctttccaatcgtgtgtgatcagccagccaggatggaaagttcggtaacggtgctgatttcaaaactcaatgagcatccggtgcggtctcaaagccattgaggggacatggtgttcatcaaaacctagaagtcagttagatggcccgcgtggctccaagtatatctgaggaagaattgaattccttaagctcagatgagcaatctttctatggtggatcgattgcgaggactataacttgatatcaggaacgcttctacacatgaaaaattcaaaatcgctacaaatgaaactttggaaatgtttacctttaagggttacggtttgcagtttgtaatcattaacgttgggtcgctggttcgatcgagcctgttcgttgaaacgcgactttcatgcctttaggcgaagcgcgacaacagtccgccgacgtctgcgtgctgaaccgtatgcttcgagatcttctcaccgccacctaccgacaatgatgtgaccaaccatgtcgctcggcttaactcaaggaacacgaatattgcacctctgtgcggatttcggtcttattgtcgtaatgactctgggaagcttcatgatcgtctcctggagcttgattgcaccccgtgcgaccacactctcgcagagcgctgggcgcagttcacgcctgcggaagtccagagtggcgtcaagctggcgagcgaaaccggtcaggtgctgaagaccatcgaaggctatatcgtcacggtaaatcatgacgcggactcgagcgcgacgtcggcacgcgaacagtcggtccgccttgccgaggtcaatacggcagtcaacctgatagaccaaatcatcagcagaatgcagcgatggcaaagcgagcaacgcggcgagcgcctcgcgcgcggggtgaggccgcacggctttgcgatctcgtcggccggtcggacctctcgcccggtttgcctccccagcaccgcggatggcgtcgggtgtgaccaaggccattgccgacaaagctgccgtcaagcaggtggctaggcaagagttccgagttgccctccccgatccgaacggtgaacctttcgcactcggggtgattccaagaggctcgcccaccgaacgagaggggagcgtcaggacagccctcggtgatcgcgcctcaggcttcattcttgcccagggttcgaagagatttttgccgaactctcggcaccctccttaagcgccacaccgctcaactgcaagcgcagcgcctcccggacgatccaggcgatcttatccgcggcaatctcgtagccgagcccgtcggcgtgaatattcgaaatgcagttacgctcgctgtcgcgccgtcctgcctgggggcggaaggtgatgtaggcacccagactgtcaggcacgcttaaccccggtctctcgccgatcaggacgattgcaacctccgcaccgaacgccgccgccgcctcgtcgccgaatgctacccgcgcctgttcgcccaaaatcaccggggcgacactgaagccgccaagacgcttcatgcatgccttgaaaagcggaacggcatgacgctcgaccgccgaggcggaaagcccgtccgcgatgacgaacgcgatgtcatggctatcccctggcattggaagatcggctgcaagcggctggcgacccagatccgggcgcgacaagtagatggtacgatccgtggcgcaggacctgatccggatcgttgataccggtgcaagctgcttggcgagggcgacaaaatccacttgaccgtgcacggcgtccctggccttcgcatgggccagctggaaatccagaattgccgaggtcggcaacgcgtcgcccgctctaccgagtccaatccgggcgcgtgtcgaatggcggaagcgctcaaacgggtctcgaccccaactcatgcggacaccccgtagctcaagagattgcgagagaattggcccgaggcgctggcgggcgccagccggcccgagtgatcaagcatgcccatgcgattgagccaagcctcaaattcgggcgccggcggacgattgaactgatgcctgaggccgacaatatcgtgataagacaggctctggtagttaagcatgacgtcatcagcgccgggcacggcaatcatgaaactgacgcccgcgacagtcaatagcaccatcagattgtccatgtcgtcctggtctgcctcggcatggttggtatagcagacatcgacccccatcggcacaccgagcagttttccgcagaaatgatcctctagcccggcgcgaatgatctgtttggcgtcgaacagatattccggtccgatgaaaccgaccacggtgttgacgagcagcgggcggagttcacgtgcgactgcgtaagcccgcacctcgaccgtctgttcatccacgccgtgatgtgcatctgccgaaagagcgctgccctgaccggtctccagatacatcacgttgtttccgacgctgccgcgcttcatcgacagcgcggcgtcattgccttccctgagaacggcgagatcgacgccgaaaccattgttggcagcctcagtgccggcaatcgactggaacacaagatcgagcggcgccccggcctcgatcgccttgatggaagtggtgacatgagtcagcacgcaggattgggtgggaatctcgaaccgctcgcgcagccggtcgaaaaggaccatcaacctggtgcaggcatcgaggttgtcggtggcgggatttatgccgatcaccgcatcgccgattccgtagagaaggccgtcgagtgtcgaaccggcgacgccttctggatcgtcggtcgggtggttgggctggagccggctcgacagcctgcccggcaggccgatggtggagcggaaggcagtgaccacgttacatttaccggcaacggtgatcagatcgtgattgcgcatgatcttggagaccgccgcgaccatttccggcgtgaggcccgtcgcaagtgctgccagcctttcggttgtcgcgtcgtaggagagaagccaattgcgaaactcgccgaccgtcatatgtgaaactggcgcgaaggcaattgggtcgtggcgatcgatgatcaaccggctgacctcgtcgacttcgtaggggatcaacagatcctccaggaatgtcttgagcggcatgtcggcaagcaggcagcgggcagcgacccgccgctcgttgcttgacgctgcaacccccgcaagcacatcgcctgacttgagtggcgaggcacaggccatgaccgatttcaggtcggcgaagacatggcgctcgcgtccaagtatgatcgaatacattttatctccgctcgtgggtatcaggcagcccatttcttgcgcaagggcgaagctaccttcaagattgtaagtccagcccgaactgggcagtgcgggcgccatgcctcctgaaagctatgcacgatccatgccactcctggcttgggcgcgcgcggtccattcatcgaagggcttgtgctcctaaggtgcctccggacgatgcaagccgtgaccgaagcatttcggatccgccatggatcatgaggcgttcggaactcgattgcccgaggcggcttcaactgaccgtttgcccggccttcactgtcgaggctgcctttccaatgagcctggagagatagctgccaaccgcagcttggtcatccgcggccaccaggaggtcatttctcacctctatcatgacatttggaataccgttcgcgatgccgtgctcgacgagcgtgtgcgtgaccccatcggctggaccgtatggctggttgcgcatgacgacatacttgcgatcggccccttcgaattccgcgagaattgcatctgcgagcgtcgtgtcgctgtcgtgcaatatcccgatctcgacctcgcgcttcttgccgaaatagacgggggtgaaactatggactgtgacgagcatcgtcccgcgcccctgggccttgcgagaggcgagaatttcggacagtccatcacgaaagggtagataaatctcgttgatccgcgtcaggcgatctgcttccggcatgctctgatttcccggaacgtcatagatctcgcttttgccaacaattgcagacactgcctccggcgggcgattgcagtcgtaaacgagccgcgaaaagcgctggtaatagaggaccgcatcgagagatgacgaaagatatcgtgcgagttccagggcgcccggatcccaggcgatatgacttgaacgcgcagacgcatcaaggccgaggtcgccgagtgaaggcgggatcaggtgtgaagcatgctcgcatacgattacaaacttgccgagcgcggccttgttttcgatcgcgattgcagactcgccaggggcgagcaacgacaatttacccataacagtctccgttgatatccacacaataacaacgaaaacaataaaagcaacatgatatcaacattgcataaagtagccctctgtcgcggtggaggtttcgccacgtcacggcccctcgttcgctacgccgatttctaactgttgccgaaaacatgggcaaaatgcctgcaaaatatgcctttttgtaaggcagatcctcagagcattttatccaattcccatcctgtgccgacgcttgtgctgtcagccgcgatcactctcatggcgattttcttagctacggaaattgaaaaaccctcatcgggtgtgttgacaaacgcaaaatatccacataaatccacattccaaggagatcgcaatcgtggatttttcagttctttcgctcagctcagcaattgtttccggcaagctcacatccgaagcgctcgttcaggaatgcctggcgcgcattgcgcggctgaaccccatcgtcaatgccttcagccaggtgtttgaagaacaggccctcaaagaagcgagggcctgcgatcgcgaggcagccgaaggtcggttccgtggtcctcttcatggtatcccgatgggcgtgaaggacctcttcttcgtggaagggcagctatgccagcgcggatctcgtgcctataaggatttcgctcccaagatgacggcgccgatcgtccagaggatgattgacgccggatctatcatcatcggcaagacgacaactaccgaaatggggtggtccggttccggcttttccgaattctatggcccgacgcgcaatccatgggaccccaagctcacaagtggtggttcgagctcgggttcgggtgctgcgctcgcggcccgaatggttcccttcacattggggtccgatggtggcggttccgtgcgcatcccggcagctttctgcggtgtgtttgccatgaagggctcgctggggcgcgttccggcttggccctggagcgcgacggagatgctgtcccacgccggtccgatgagcgtcacggcaaaggatagcgctttcttgttcaatattgccaaggggcccgatccgcgagaccatcaggcgctgccggacgacggagcagattacactgaaacgcgatcgacaaagtccctccggattggttttgcaccaagcctcttcgggttcaaagtcgcgccggaaatcgaccgggtcgtgcgcgaagcggtcgatgcgctcaccaaggcgctcactatcgatgttcgttcggtttccccggactgggaagatccgatccgtatcttcgagacactctgggttgccggccggggcgtcgcctatgggtcccagtcggatctttccgattttggcagcggtttccgtgcgctcgtcgaagcgtcggcacgctacgatcttaaggattatctctcggctgcgaaagcgcgcgcggaatttgctggtcgcgtgcacgcactctttgaggacgtcgacctgctcctcttgccaaccatcccggtcgagccgtttgcggcggatcgggaggcgcccgaagggttccaatcgccctcggaagtcctcgcgtggacgggctggacgccctttacatatcccttcaatctttccggcaacccggcagcctcgttgccttgcggcctgaccgtcaacgggttgcccgttggcctgcaggtcgtcggccgtcgccacgccgatgcgcttgtcatggcattctgccagcaggccgaggaccatcttttcaaaaacaacaatcctccacttgtcgttgctggcgacaagatggggtggggaacgcccagcaaatcaactgtggagatgtcgtcatggagttcaatagaagatcgctcttaaagagttcggcgcttgcgggcatcgcacttggcatgcctatcctcaatactaagttcctggtcaacccggccaatgccgcggaaaacaaggtccttaaatttctctcggccgaaactctgaccggcaactgggatccgtcttctcacacgacgctggcgcagatcaaccttgagagctttgtgttcggttatctaacccgcgcaccgatgacgccggaaaagcctgacgagctcgtcatggaactggcgaccgagatgaagctgatcgacgagcacacgctcgaattcaagctgcgcgaaggcgtcaccttccacgacggcaagccgttcagggccgaagacgtcaaggcgacattcgagtatgcaagtcgccccgaccgaccggccgcctggtatcccggtccctgtgaagtcgaagtcgtcagcgattacgtcgcgcgcgtcaagaccgacaaggccggctaccccgcaagccttttctggttcctgtcctccttcctgccgatcatgtcggcaaaggacgtcgccgacccgaagacgctctctgcccggccgaacggcaccggtggtttcaagttcgtcaagcaggacggcaacacgaccgttctcgaggccttcgacaatttctacctcggcaagccgacgattcccggactgcatttcagcttcgtcggcgatgcgacgacccggacactggcgcttctgaatggcgaggccgaccttatcgaacgccttgaagccgaacaggtcgaaacgatcgaaaagaccggcggcttccagcttcacaaggcgatctcggtcgagaacaagtatctttggttccgttgctcgaagccgcccttcaacgactggagactgcgtcgcgccgtgtgccacgcgatcgaccggtcggtgatcgacgatattctcggcgtttccggtcacgcgtcgaactgctacgtgtctccggtcaagttcggctatgtcgatatcccgaactatccgaagttcgatccggaccagtgccagaagcttttggcggaagccggcttcccgaagggcgaaggtctgcccgaactcgaatacatcacgtcggtcggcttctacccgaagaccaaggaatatgccgaggccatcacggcgatgcttcaggaacagggcttccccgtcaagctcaacgtcatggaagtcgcggcctggggtgacgcgctctacgatcgtcccggcggcgggcccggtcatatgatcgactgcggctggtcgacgggttcgccggaacccgatctggtgctgaggacccatttccactcgacgacgcaccgcatctgcggcatccaggatccggaaatcgatgctgccctcgacaaagagcgcaacgcctcaaagcccgaggaacgcaagaaggtcattcagaccgagctgatgccgttgctggcggagaagacgccatcattttctctcttcacgtccgttttcatccacggcatgcgtgatggcctgagtggtctctacatctacccgaatggtatgatggacgccaacaaggcgacattggcctgatccagcgctgcggccactgcctggcagtggccgccttggccccgacagactagggtaagtacatgttccttctatcattcctgatgagacggcttctgcagggggcctgatcatccttctcgtcatattcatcatcttcacgctgttgcgtgtggtgccgggtgaccccgcgcgccttatcgtcggcggcatggcccctgatgcggtcgtggcgatgaaggcaaaggaacttggtctcgatcgggccatcccgctgcaattcgtctcctatcttggccatttggcgaccggcgatcttggcacgtcgttcgtcaggccgaagagcggggcgagcctggccggctcggcctataacgacccgacacgcgaagagcgggcgaaggtcctagatctcattctcgatacactcccgatgaccctgcagctcgcagccgtcgcactggtcatcgcgttgctcgttgctgttccgctcggccttgccggcgggctctatcagggtcgctggcccgacaaactcgcgctcgcattggggtcgatcttcgtctcgaccccgaacttctggctgggcatcgtgctgacgctctttctgtcggtgaagctcaggcttctgcccgcgatcggctacaacggcttcgaatacaccattctgcccgcgatcgtgctcgcggtggagattgcgccgttcatcctgcgtacgttgaccgtttctgtcgctcaggtgttgcgcgaagacttcattcagcttgctgctgttagaggcctgagccgcgggcgcacgatcttctcgcatgtgctgggcaattccgcggtcccgttgatcaacttgctgggtgtgcaactcggcatgcttctgggcggcgtcctcgtggtcgagttcatcttcgactatccgggccttgggctcctgacgatcaatgccgttcaacagcgcgactttccgctcatccagggcgtcgcgatcttcatttccgtgatgttcgtggtgatcaacatcctggtcgatcttatcgcgatgaccatcgatccgagactggaatactgagatgaccgatatcgtagaattgagcgccaccgagcgcaccgtcgtcaagcgcggcaccacaccgaccagacgcatgttgcaaattgccgtggggcgcctcgactttcgcattggcctcatcggcttcggattgctgcttggacttgcgattctcctgccatttgtcagttcggttgatccgctcaagatggcctacagccacaagtttattccgccattcccttccgagggctggcaatggccttatgtgctcggtaccgatcaactcggccgtgacgttctgatgcgctgtctcgtcggactgtgttattcgctgttcatcggcgtgacgaccgtggttctgatgttcatcgtcggctgcagtctcggtcttcttgccggttttcgtggtggttggctcgatacggtcatcatgcggctgaccgatgctcagctgtcaattccgatgatcattcttgccatcaccattctcggcgtgtcacgcccgaccgtgcctgcgatcatcctcgtgcttggcctctccggctggccgctctatgcccgcgtcgcgagatccgtggcgctcggcgaacgcaatcgcggctatgttctcggtgagagggttctcggtgcctcggaccttcgcatcatgctgttgtttgtggcgcctgtcgttctgcctccgatcgccttcgtcgctgtgctcgatatcgcccgcatgatgatcttcgagtcgatcctcggctttctcggtctcggggttcagccgccgacaccgacattcggcaacgtgatcgcggattcacgaaagtatctgctgaacgcatggtggatcgcgacgatgcccggtctgttcctgctgatatcgctgacctgcctcaatctgatgggttcggcgttggagcgcgcgcgcaatgcggttctgagaggggatgcgtaaatgagtgatccaatcctagctgtctccaatctctcggtcgatctcctgcgggatggcggcaaacggcgcatcgtcgacaatgtggactttgcgctccagccaggcgaagttctcggcctcgtcggcgaagccggatcgggcaagtcggtgctggcgcgtgccatggtgaacgccattcaagcaccgctggaaatctcttccggtcaggtgatttttgaaggaaaggacgtcctctccctcgatgcgcggggtcttcggtcgatcagaggaaaccgcattggcttcatcggtgcaaaccccatgggttcgcttgatccgaggctgccgatcggccatcagatcgtcgagaagcttcgatctgtccggcctgatatcggtaaggcggaagcgaaggaaaaagttctcgatctccttggccgggtgcatattccctcaccgcgctctcgcttccacgaggcgcccttccaattctccggcggtatgatgcagcgcgtgatgattgtcgatgcgctcgtttccgagccatcgcttgttatcgccgacaatattacgcagccgctcgatgtaacggtcgcagcccagattatccggcttatcgacagcctcaggcaaagcctcgacacggcgttcctgtttatctcttcgtcgttaccggtggtgtcacagattgccgagcgaacgctcgtcatgcaaggcggccgcatcgtcgaacggggcaagactgccgatattgctgccaacccgcagcaagcctatacgcgcgccctcctctcgcgcattccatcgatctggaagaacgtgtcggcgccggaagcaaaagacggtgaggctgtcctgaccgtcgaaaatgcaacccgaacctatagcgtgcgccggcgcgatgcgttcaatgccttcaacgaagtcaaggcggttcgggacgtgtcctttaccgtcaaggcgggtgaaaattttggcatcgtcggggaaagcggttgcggcaaatccacgcttacgcgcctgcttgcctggctcgaacagccaaatgccggtcgcattgcgttcctcgggaagaacctctcgagtctctctgctcgttcgttgacggagatgcgcaaatcgttccagcttctgctgcaggacccctatggatcgctgccggcgggcatgtcgatcatacgcatgatcgaggagccgcttctgatccacggcgtcggccggcgtgatgccgagcagcgcgcgcaggaggccatgcgcgaagtcggccttcatgcggacctcgccgaacgattgcctgtggggcttagcgccgggcagcgccagcgcatcaacattgctcgagccctggtgctgaagccgcgcctcttgatccttgacgagaccttgtcggcgctcgaccaggtcgagcaggccgagctcctcgatctcttcaaacggctccaggcggcacacgggttttcctacattttcatatctcacgacctggcgctggtccgtcgtatctgtcaccgcgtggcggtcatgtatctagggcgcatcgtcgaactggctgacaacacgacgctttttgaacatccgcaccacccgtatacgcgggcgctgctgagcgccatgccgacgctggaggaaaaccgtttcccgggcgcgcaatatctgctcgatggcgagcccccgagccccattcatcttccggtcggctgctcgttccgttcgcgctgcccgcgcgcgcagagcgactgcgaaaagaccgatccgatgcttgtgggttctgatggcgggaattacgcagcctgcctgcatcggcatgaggacgaggcggtccatgtccagtgagatccgcaaggagatcatcctggagcgtctcggccgtgatcagcgcgtcagcgttgtcgagctttcagcagagttcggcgtttcgggcgaaaccattcgccgcgatctgaagaacctcgaagcagaaggtgctgtgcgccgcgtgcatggcggcgcaattccagccggccgcacagccgacacgccgattaccgagcgcatcaagctcaactcgactgagaaggatgcggttgccggcgtggcgcgcaacctgatcaatgacgactgtgtgatcttcctcgataccggcacgacgacgcttgcgctcgcgcgccggctgatcggcttcaagaagcttcggctctacacgaattccctgatgattgcacaagccgcctgccagcatttcggcgtcagcgtgcacgtgacgcctggaaatctgcgaccggtcgagcaggacctggtcggctatgacacgctatcctacatccagcagttccacttcgacatggtcttcatgggtgccgcggcagtcaatgtcgaatatggcttcatggactatgaagaagacgaggcgcgaatccgtcagatcctcataaagcggtcctcgcgaagcgtcatgctggccgatcattcgaagtttggaagggtcggcaatgtgatcaccgctcccttcgggcaaatcggtgcgcttgtgaccgaccggcgtccgccggaagacatcctcggcgccgttcgggcagaagaactggagatcatccatgcttgacgcggcgacgacacggcggacggatttcgatgcgatcttcgaccgaatttctgccatcggtgctcatcccggagcgggagtgacgcgcctcgcggcgagcgccgaggacggcatggcgcgaggtgtttttgccgtgtggatggaacaggcagccgtccagatcgcgaatgatgcgatcggcaatcagtttgcctgcttcgattgggccggtcaggatgcgccctggatttttgcgggctcgcatctggacacccaaccccgaggcggtcgtttcgacggcaccttgggtgtcctgactgccggacaggccgcgctcgctattcacgccgaggtgcaacgcggactgtgcaaaccgcgctacaacctcgcggtggtcaactggacgaatgaggaaggcgcccgctaccagccgagcctgaccggcagcacggtcttctccggcgcattggcgcttggcgatgcattggaactacgcgacggagacggcgtatccctcaagcgcgcgctcgaggccataggcgtcagcggcagttcgggaattgttccccctcccccgaaagcctatgtcgagctgcatgtcgagcagggacggaaacttctcgaagcgggccgaaagatcggcgtcgtcgaaggaacctgggcggcgcgcaagaagaccgtccgctggatcggccgggcagcgcatacgggtccgacgccgatggccgatcgccgagatgcgcttctcgccgcagcaagaggaattgccgccttcgaagcagtcgtcgcggccagccatcccctcctccaccgctccgctgcgcgcctcgtggtcgagcccaactcgccgaacgttgtcgtcgaccgggcgactgtgtggttcgagctcagggggcctgacgtggccgaactcgacatggcaggtgagctcgcccttgccgcgctcgaaaaggcggcagccgaaaccggcacgcagctggaaatcgtcgccgatactttgcgcgatcccgccagcatggacaggcggttaatggcactcgtcgatcgcacggcacgttcttgcggtttcgagccattgaccatgcgttcggttgcaggccacgatgctgtcgccttgcaaaacagtggtatcccgtcggcgctgatcttcattccgagcgtcgatggcatcgcccatcatcccgacgaactgaccgagccacaggacgtgcaggcggggctggcggtgctgaccgccacgcttcgcaacatcattgagggagagttccatgcaggatgatgctgcagttcaggctgcgctcgacgcggtcggcctttccggcgccaccctctcagctccgattggcggagtggtgtcgcccattcaccgcggcgtcgaaaatctctgctttttcgcaagcaaggcggatcagccgcgggttttcgtcaaacgtctccacgatgacatgtctcggtttgttgccctgaaccatgtggcggaggccagccgcaaggcaggcgaactgggcattgccccgcggctcatccatgccgctcccgagggcggcgtcctggtattcgaagcgcttggcgaggaatgggcgtgggggcatgccgatgtccttcgccgcccgcgggttctcgaaaatcttctgacggcaaaacgcagcttccatcaggctgagaggcttggcgaaacgcgcagcgttttcgagctcgttgccgcctaccggcagcttgccgaaggagcggatgtgatcttgccagcaccggtattcaccgtctctgctgccgtcgagcgcattgccggcgccatcggcgccgcaggtgtcgatacggtcccgtgccacgcggacggcatctcgtcgaacgtcatggtcggaccggacgacggagttcggctggtcgatttcgagtgggcgcgccaggcggaccccgcgtacgatatcggaaccgtgctggccgaactcctcccattcgatggcgaggcgctgctggccattgaaatcgcaaccggaaagccggatgcgagcgtgctcgcgcgggcacgcctttatggagcggccgacgatctcatgtgggcgctttggggcttcatcaatgccgcacgctcgccgcgcaagcatgtggaattcttcaaatacgccgaatggcggcttctgagagcccgcacggtcatcgaaggaccacgctttgaaacatggctgaaacaggtctgatggagagagcgatgagactgagattgggtgaaggcgcatcgcaggccgagcaggcgatcgagcaggccatcatagccgtggcggactggcgaggcctcgaggtttcctacgaaccagtacccgggggcatcagcaatcccaactggcgggtttacgtcgaaggtgcgccgcacagcttcttcgtgaagatacccggcgctgggaccgaaatgttcatcgaccggagaactgccaacgaagccggccgcagggcgcacgaggcgggcgtcggcgcccggatcatcgagttcttccccgaaacgggggtcgaggtgagtgaattcgtcgaggggctcagaacatcgacaaacgccgattttcttgatcctgtcatccgcctcaacggtcttcgtgcgctgaaggccttcaacgacaccgcaccgctttcgcagcgaaagaccaccttcgacatgatcgacgaacatttccagcaggtcctggagcttggcggcgatttcccgagcgacttcggctggatgaatgcgcgctatcgcgaggcgcgagctgcgctcgaggcatcgggtctcgatctcgcgccctgcatgaacgacacactggccggcaatttcctccttcattccgatcgccgggtcatgcttgtcgatttcgaatacgcctccaccaatgatcgggcggcggaactcgcgctttggttctgcgagatgtgcttctcgccggagaccgaaaaggaactgatcgaggaatattatggccgggcggatccgggcgttctggcgcggatcgctttgttcaaggctctcgtcgacctcaaatggtcgacctgggcgatggtgcagaacgaagtctcgcgtcttgacttcgacttcttcaaatatgggttctggaaacatatgcgcgcgcgtttcgcaatgagcaattcgctgtggccgcaatggctgaaggcggtctgacacatgcaaagcactgaagaggtgatctctcccgattttcttcgccgcctcgcggcagttgccgcccgcgagacattgccccggttccggttgccgggagccgtcgtcaacaagattgccggcgggttcgatccggtcaccgaagccgaccgcgaaacggagaaagcgcttcgagcgcttatccgttcggaatatcccgatcacggcatcctgggcgaagagttcggcaatgaaggcgcggatgcgggcctggtctgggtcatcgatccgatcgacggaaccaggtcgttcatatcaggtatcccgctctggggcacgcttgtcgggctgaccagggatggtgatgcggtggccggcatgatggcgcagccttttatcggggaattgttttatgcgacgggcaacggcgcatactacgagggccagcacggacaaacgcggctcgcaaccagcgcgacgaagaaccttgccgacgcgacgctcttcacaacgacgccggcgatcttcgaagccgaccggagagcaagctacgaccggctcgaaaaacaagtgcggctcgcgcgttacgggaccgattgctatgcctattgcatgcttgcggcagggcagatcgactgcgtcgtggaagcgggcctctatccctacgacatcgttgccctcattccgatcatcgagcaggccggcggcgtcgtgacggactgggacgggggaccggcagaaaatggcggcggtatcgtggcggcggcaaattcctccctgcatgcgcaaatcatggctttcctgcacggggattgaccacggggcttcctcagacggcggacaccggtctgacgctttcggtatggtcaaccgtggatgatttcgaggtcgccccttttggcggccgccaatatatttgccgggggacgttgatcggtgaccaatgtgttaacgctggaaaatgcggcggtaatgacattgcccgtcttgccgcacttggaatgatcggccagcatgatgcttctggccgtctgcttcagcagagcctggcgaattcgcgcttcatcctcttcatagtccatgaagccatactccgccgcgattgccgccgcacccataaagaccatgtcaaagtggaattgctggatgtaggacagcgtatcatagccgaccagatcctgctcaatcgggcggagatttcccggcgtcatttggacccggacgccgaaatgctggcaggcggcttgcgcgatcatcagggaattggtgtagagccgcagcttcttgaagccagtcaggtggcgcgcaagggacagggtggtggtgcctgtgtcgaggaaaatggcgcagtcgtcggttatgaggttgcgcgccatcagcgcgaccgcgtccttttcgagcgcattgaatctgatgcggtcggtaatcggcacatccgcggttcggccggccggtatagcgcctccgtgaacgcgccgaacggctccctcggcctccagatccttcaggtcgcgccgaatggtttcacccgaaacaccgaactctgtcgaaagctccagaacgctgacgcgttgatcacgatcgagtcgttcgagaatgacttctttgcgaacttcactcgacattgacagcttcgtcctcgggtcggtgcgggggtcgacagtaacgctgatgctgacaatcccttaaagcggcagatctatctcgcaagccttcggaaaaggttgcgagatgcttgtaaggatgacggtgaaccgggaagtcgacgacgttgtccttggatttgtgtatttatgtggtgtttgcggatctttcaaacaaattacgcgatcttccaccgcgcaatgaccatcccgcccgcgcgagaatcgctgcctatgtgatcagcaacgcgcttgccttccatacaaaatgaacccttcgatcgaaatcctggtccggagtgaatgcgattctgtccctgctccatgtgggaatgttggaatattgagggcatatcaccggagaattgagctaaaatccacaaaagcaacatctgaaaacctcaaggttcttgagggcgtgcctaagcaacatattgaaaatagaaagaaagttatgacccgtaacggatttttcagaactgtcgtcgatgatgattagcaactgtttgactcgaaatggattcaaaatgcagattttccacaatgctttgcaattgtcccaccgcatgcgatccattaaggccaagtttgccgtggtgatcatagggacagcgatcgtctcttgcgcgtctgtcggagcattgagctaccagatcggaaagaacggtttgatcgaggcgagcaagatccgccttgaagcgattgcagccaatcaatcgaaggcgctccgggcctatgatgaacgggtcgagcagacgctgaccgagatcgcgcagagccagtcgctcggagagatgacggagcaggccggaaaggccatcgcaatgtctgatgccaagataagggaggcgttccaggacatgtcgaagagccccgcacaaagagcggctttcgacggatcgaccgtcaagatgctctatgccgtcaagcatagctcggtgcatgggccactcttcagcgcctggaagaatgccgatctcagcgatatcttcgtcatcgataacaatggccaggtggtctatacggtcaccaagggacccgagttcatggcggccgtccaggattcgcagaatgccgccctgaagtccctgtttgcctcatccatcgccggaccggccgaccaagtgtatcggacggggttcgtttcgttcaaaagcgaggaaagcgatgtttcggcttttcttgccaaaccccttgccaacgttgtctggggctctgtcgtcaagcgcggcaccgtcgtgatccgtatcgcgccggcaaagcttttggcgctcatttcgcccgagggcttgggacggagcgtcgacgaggcgtttctgattgccgccgacggcaccttgagagcaggcaacgtcgcagcggaaaatggagtgccgccggagctgctcaaggccgcgaacgagcagaagaatggctccgtcttcgctgatggggcccatggttcaaatttttactcctacgtccctgtcaccctctttggtcagccgcaccttctcgtcatcggccagagcaaggctaatgtcgtctcctcggcaaacgagcttgcaaagtgggccgcgctgaccgctctcgccgtccttttcggaatgggtatcgtcgggtacatcttctcctcccgtcttacgaagccgctcgcggacatcacaggcctgatgaaccgcctgaacaatggcgatcaggcaatcgagatccggtccgtctcgcgttctgacgaaatcggcatcatggcgcgggcgctcgaatccttccgccagggggcagtcgacaaggtgcgaatggaggaggaggcgatccagcgtaaccgtcagatcgaagaggaaaggcaactccgcgagacggacagggaaaaaagcgcggccgagctggaacatgcggtctcggcactcgccgccggcctgaagaacctggccgacgggcggctcgatcatcgcattgcgactcctttcgcgccctccctcgaccaactgcggaaggacttcaacgcctcgatgatgcacctgcaggcgacgatgcgccagatccgcgacaatgtcgaaatgatccagggcaacggcaaccagatggccgaggcggccgaggatcttgccaaacggactgagcagcaggctgcttcgctcgaagaaacggcagccgccgtcgacgagatcaccgtcacggttcgctcgtcggcggaacgtgccaaggatgccgaccagatcgtccgccaggccaagcagagcgccgacgattcagccatcgtcgtcaacaatgcgatcgatgcgatgggccggatcgaagaagcctcccgccagatcgagcagatcaccggcgtcatcgacgagatcgccttccagaccaatctgctggcgttgaatgccggcgtcgaggcggcacgcgccggcgatgcgggcaaaggctttgccgtcgttgcccaggaggtgcgtgaactggcgcagcgctccgccaaggcggccaaggagatcaaggtcctcatcaacaagtcgacggccgaggtcaataccggctcgcatctggtccaggaaaccggttcggtccttgcgaagatcagctcgcagatcgtcacgatcagtcagcatgtcgagacgatcgcccgcggcagccacgatcagtcgagtgcgctgcagggggtcaactcgaccgtcaatcagatggaccagatgacacagcacaatgcggcgatggtcgaggaaacgacggccgcgagccgcgaactcgcctcccaggccgacagcctgctggccctggtccagcactttcaaatcggaggcgaagatgaagcggcgttggcccacagtcgggcggcgtgatttgccgcagttgacatcgattgacgcggcgtcccgttctttcaaggcctcttctacggccggtcccgcgcatgtcgggctgggatggtggcggtgaacccagccgccaccacggtcttcaactttccaccatgaaacgggagatgaatggcaggcttgcagcaccgacggccttcggcgtgttcaatatgccgctcggcatcacggtcacttcgggaaccagcttttgcagcgagacgcagatgttccgatagacgacattcggcacgaatgaagaaacgatcaccgcttcgagctcgacaaattgcgcgagcgacttgacgatgccctgcatcttttccgccagtttgccttcccattcgagaaccagactgttctccggccatggtgcgagcggctgccacaggtgatccgttggcgcgcccacggcggtcaatacggattccaaagatgccacgccgacatcgaaactgaccaccgaattgccgtggtggatctggtggttcaagaccaggcggctgtggaggttcgcgccgatataaaagtagagataatcggaaaacggcttggcgacaccgaacatgctttcgccgctggccgcagccgtaatgtcgttctgcacgaacaccgagtagccggtaagctcctcgacttccttctggagcgagtcgaagtaggccttttcctcacgcccctccgaagcgctcgacggaagcgcaaggccaatgccggctagacgcttttgagcattcttggggacgatgttcaccgcctgacgaatggtctcgatgaacattgtctggttgctgtcgcgttcgggctgcggattaggcaattgcatatgatagcgaacggcgccggcaaaatcgatcagaacgacgtcggtacgcttcaggccgacactgatgccgatcgaaaaggccccttccggattgagggcaaccggaacggtcggaggcccgacccgtcccttctgggcttcccccttcgcaaccagtccttcctgctccagcgacctgaccagcaccgaaatagtctgggctgaaaggcccgtccgttcgccgatctccaatcgggtgatctcgctgttctgaagcaacagcgacagcagcaggcgctcattgtaactgcgcacgctgaccgcattcaggccggttgcccgatcggcaatacgcaagggattgggtggtgcaaaacgcatatcaggcatcaatgcaatcctcttggagtaaggcataaagatgtactggcatccattcgtaacgtcgctgcggcaatatcatcatctccaaccgatcgcctcgacttccctggcgagcgccgttcccaaggcttcatgcgcttcccgattgatgtgaaagccatcgcgcggatcgcaagccgcgacggtggcggcgtcaaaaaaatgtacttcgagcgaatcggcaatgatttcgaattcgagggcgagacgccgggatttctcctgggcgccgaaaaatatgggttcccattccttgatatcgtccagcatcggcggtggagcaaccaccatgatttcggggggcttgccggccggaccgggcgccagctcccggatatcgtagaccaggcagccaatccccatcgccacttcggagggaggctggtggaaacgggctttcaggtcgttcgtcccgagcatgatgatgacgagatcgaggattgcgtggctcatgaggcatggccggaggtaggttcggccattcttcatcgggccttcgatcggatcgtctcgaaccgtcgtacggccgctcaagccctcctcgaccacataccacttgcttccaagctcccgtctcaaaacgcctggccagcgctcgtccggcccatatcgatcgagcggcgagccgcccggaatctggccatgcgtattcgagtcgccgtaacataagactgaccgcatttcctccccacctttatggcaaatcataaagacgcatgaacattcaacggcgattatggcctttgtcgatccatggtgcaagtttattgatattcattcagtctgaataattattgacagccgtttatccgtgtggcatttctatgaatgggagagcaagattttccaggaactgaacatagccagcccagtcatccaatggctttggcccgcgattaaagccgcttcagcggcctggataaatgtgtctccgtggcaatggagatccgacgtcgagaggacgacggtgtttgagcaagggaggaaatctcgtgaacggctatgtgaaatctatcctcggggctacgcttttgatggcgtcgaccgcgggcccgctatgggcggatgaagtcaagtttatggacggcatcacgccgaaggctggcgacaatccgcagacggaagccgggaagtacaagaaggactgcggctgggttatcggcatgagcgattttggcgtcaacgccaacacttggaccgttcaggttgctcacgaatcggaagcggcggccgcagccaacaagtgcatcaagaagttcatcctgctcgacgccggctttgaccagaagaagcaggttgccgacatcgaagacctgatcgcccagaaggtcgacgcgatcatcgtgcagccggtcacctccacctccgcaaacgcctccatgaagaaggcgattgccgccggcatcccggtcatcgttcataccggtcgcgtcgaaacagaagactacacgaccgagatccagggcggcgccgagcacttcggcaaggtcatgggcgactggctcgtcaagaccgtcggcgataacggcaagatctgggttctgcgcggtctcgccggtcatccggaagacaccaaccgctataatggccttctggaatccctcaagggcacgaacgtgaagatcgtcgccgaagagcacggtgactggcagtacgacaagggcaagagcgtttgcgaaacgctttacctgaacagccccgatgtcgatggcatctggtcgtcgggtgccgacatgacgcgcgcctgcgtcgacgtcttcaagcagttcggcgccaagatcccgccgatctccggagaaggcaacaacggcttcttcggccagtggatccatgacggcttccagtcgatctcggctgaatattcgccggcccagggcgccgaaggcgtgcatgccgctgtcgcactgctggagggcaagcagctctacaagcactacgactacaatcctccgggctgggacctggagaaggtcaagaagtattaccgcgacgatctctcggcgaacgtctggtggccttcccagctctccgaggacgacctgaagaagtattataccaagaactaaaatagcctcccaaggcgcatccgccggtttcattccggaaccggcggatggtgaccgagcggagctgcatggattgggaggaacgaatggccaaccttatagaaatgtcgaacatttcaaagtcgtttggcggaagtctggcactggatagagtgtcgctggagctcttgccgggttccgtccatgccctgatgggcgagaatggcgctggcaaatcgacgctcatgaagatcctcgcgggcgttcaccagcctgatagcggcgagatcttcaagaacggacacaagatcgccttcctcaatccgaaagaggcgctcgacttcggcatatcgacggtcttccaggagatgacgcttctggcgaacctgacgatcgccgaaaacatgtttctcgggcgcgagcccgtaacgcgcttcggcaccgtcgactacaaacggatgaatgccgaaaccggaaaggcgctgaaagagctgtcgctcgatcttgatccgcggacgctggtttcgaacctcacgattgccgaacggcaattcgtcgaaatcgcccatggcatcaaagccgatgcctcgatcttcattctcgacgagccgaccgccgcactcaacgccgctgacgtcgagatcctcaacaagcatatccgccgactgcgcgatgcgggcaaggccctcgtctacatctcgcaccgcatggatgaaattttccagatatgcgacacggtcacggttctgaaagacggcaagctgatcggcacgcgcccgctttcggaaatgacgccgacatcgctgatcgcaatgatggtcggccgggaattgaaggaccttttcccggcaaggaacgcctcggcagcctgcgaaccgatgctcgacatcaagcacttcaagatcggcgcttcgtcaaagccgttctcactgcatgtttgcaagggtgagatcgtcgcacttgccgggctcgaaggacagggtcagcaaaaactcctccgctcgctggtcggcaaattccagccgttttccggcacgatcacactgaacggaaaatcgctggccttgcccgtgccgaacgagaacggtgtgcgcaagctgcagcagatgggcgtgggcttcattcctgaggaccgcaaggaggaaggcttgttcctcaacctcccgatcgcgcacaatatcgagatcgcgctccattcggcacgagcaggattttcccccgcgaagaactatcgcaagctcgttgccgacacgatcaagcggctcaacgttcgcacgatcaatgcgtccgcgcccgtcggcgcgctctccggcggcaatcagcagaaggtcctgcttggccgctatatcgccgccaatctcgacatcctcctgatcgaggagccgacgcgcggtgtcgatatcggcgccaagtctgaaatctacaagctgcttcgcgacttcacgcagaacggtggggccgtgctggtcctgtcgagagaaactgtcgagctcatcggcctttgcgatcgcatctatgtcgtccatggcgacacggtcgttgccgacatgcccgccgccaaggcgaccgagcacgacatcctcgacgccgccttgagcgcgtgaacgccaacagagaaccaatccgatgaccaagaccctcacaagactattcaagggaaatcagagccgccaaggtctctggatcgttcccctgctgatcacgatcgttctcagcatcgctctgatcattcagacggaccagttcctgaaccgggaaaatctgttcaacctggtcgcgcaggcaatgccgctcgtcatcaccgcggtcggtcagctgttcgtcatcctcgtcggcggcctcgacctgtccgtcggctcgctgatcagcttcacgacggccatcctcgcgctggacgctccgggctacatcacgatcccggcagtcttcctgctggcggccctgctcggcctgaccaacggcatcgtgatcactcgtctcaacgtccatccgatcatcgcgacactggcgatgcagtacatcgtcctcggcgctgcgcgcatcttgcgtccggtctccggcgggaccattccggatgtcgtcatcagctcggtctcggggtcgttcctcggcatccccatgccgatattctggggcatttgtgtcgccctggtcgcctggaaactgctctacggctcgcggttcggcctgcatctcttcgcgatcggcggcggtattgccagcggcgtcgaagacgcgacgcgcaacttcggtgttgccgacaagcgcaacgtcatcctcgcctatgttgcctgctcgtgcttcgcagcccttgctggcgtgttcctggccggccgcatcgtttccggcgatccaaatgtcgggcttctcttcgaactcgacgcgatcaccgccgtcgccattggcggcacgcaactctccggcggcgtcggcagcctgcagggaacgattatcggagccctggtactggcgctcctctccaacggcatgaacctggtcaacgtttcgccgttcattcagacggcgatcaagggcggcatcctgctccttgtcgtcggtttccagacacgcaagaagatggggctctaagatgtcagccttcgcaaaaaatcccgcaattcagcgaatgcttaagattgcgcccgcctattatgtctttgcattgctgctgatcgtcctgtgggtctcgcgcccgcagatgctgaacgcaaatgtcatgggcatcttcattcgccaggtcgccccgctcggcgtcctcgttctcgggcagttgctcgtcatgcgggtcaaaagtatcgacctcgccggcggcggcgtcatcctgctcgtcaactacttcatctcgtccggccagtttcccggaatgtcggcgaccggtttcgtgctgctcgcgctcttcacgggcaccgcgatcgggctgttcaacggtttcatggtgggcaagcgccgcgtctcggctgttatcgtgacgcttgcggtcagcatcatcctcgttggtgccgtgcagttcctgtcgagcggcaagccgccgggtaacgtgccgagctacttcaacgatatctataacgtcaaactcggcccgctgcccctcccggtcctgttctgggtggtgctgaccacgctgctgtccctgcttctgtcgagaacggtgttcggccgttacgtgacctcggtcggcgcaaacgcggaagcagcgcatttctcaggcgtacccgtcgaacgcaccgtcgtcgtggcgcatacgctggcaggcctgatcgccggcatcgcggctctcgttcaaacggcttcgatcgcagtcggaagcgttcgcgtcggcctggatctgccgatcctttctgttgccgcaaccattctcggcggcgtggtcttcggccgcggcgaaggcggcgtctggggaccgttctttggtgtcctttcgttcgcgctcctctttgtcgtgatgacgtcgttcggcgtcagcgactccgggaagctcatcgcgcaaggcctcatcattctccttgcggccattttctacggcctcaaggcgcgtaccaactagtcgtcatcggaggagtaatgacatggcagaaagccgctcgatattgtgttttggggactcactgacatggggatggattccggtacccgagtcgtcgccgacactcagatacccctttgaacaacgctggaccggcgcaatggccgcagcactcggtgacggctatacgatcatcgaggaaggcttaagcgcccgcaccacgagcgtcgaggatccgaacgatcccaggctgaacggcagcgcctatctgccgatggcgctcgccagccacctgccgctcgatctcgtcatcatcctgctcggcaccaacgacaccaagtcgtatttccgccgcacgccttacgagatcgccaacggcatgggcaagcttgcgggacaggttctgacttcggccggcggcatcggcacgccctatcctgccccgaagcttctgatcgtctcgccgccgccgctcgctcccatgcctgacccatggttcgaaggcatgttcggcggtggctacgaaaagtccgtcgaactttcaaagcagtacaaggcgctcgccaacttcctgaaggtcgactttctcgacgccggcgagttcgtcaagaccgatggctgcgatggcatccatttctcggctgacacgaatatcacgctcggccaggcaatcgcagaaaaggtcaaggcgattttctctcaagaggcgaagaaagctgtggcctagcagcgttccgtcgccggccgccaggcgccatcctcccaggcggctggcggtccttttccgcaaacaagatttgaggctcccatgaccggctatgttctggcgatcgaccaggggacgacgtcctcccgagccatcgtttacggccccgatgcccagccgatcgcgatcgatcaaaaagagatatcacagtcgtttccgaagtcgggttgggtcgagcacgacgccaccgaaatctgggattctgttgttgagacctcccgtaccgctctcgcgcgagccggcatcgaggcgcgcgacgttgcggcgatcggcatcaccaatcagcgcgaaacctgcctcatctgggagcggtcgacgggcaagccgatccatccggcgatcgtctggcaggatcgccgcaccttcggcgcatgcgaggtccttcgcgcagacgggtttggcccgctgatacaggaaaagaccggccttctgctcgatccctatttctccgccaccaagatcgcctggatcctcgacaatgtcgacggcgcgcggcgtgcggccgagaatggccagctgctgtgcggcacgatcgacacttatctcacctggatgctcaccggcggcgccgtgcacgcgacggacgccaccaacgcgtcgcgcacctcgctgttcgatattcgtcagaatcgctgggacgacgaattgctgggcgccttcagagtcccgcgggctctcttgcccgaggtcaaggattgtgccgacgatttcggccagacggttgccgcccatttcggcgctcaaattccaatccgggcgctcgcgggcgaccagcaggcggctctgcttggtcaggcctgcctgaagcccggaatgctcaaatcgacctatggcacgggctgcttcgtggtcctgaacaccggcgatcagatcgtcagatcgtccaatcgtctgctgtcgaccattggctatcgcctcaatggcaaaacgacttatgcacttgagggttcgatcttcatggcgggtgccgcggttcaatggctgcgcgactccctgaagctcatcaaggcggccgacgagacgggccgtctcgcgcatctggccgacgaacaggaagacgtttacctggtgccggcattcaccgggctcggcgcgccgcactggaattcgcaagcccgtggcgcgattttcggcctaacgagaggcacggggatcgccgagctttcgcgggcgacgctggaatccgtctgctaccagacgcgcgatctcctcgaggcgatggcctccgattacccgatggacgtcaggggtgcgaccctgcgcgtcgatggcggcctgtcgggcagcgattgggccatgcaggcgctggccgattgcctcggaagcgtcatcgagcggtcgcaaagccaggaagcgacagcttacggagttgcggcactcgccggcgcgcaagcgggcgtctggcccgatcttcagacctttgccgcgaactggaaggcaaagcgcagcttcacccccaacctcaacactgacgagcgggcgcgacgctatcggaaatggcgcgccgccgttgcaagcacgctttcctatgcggcaacggcgtgacgttacgggagaccgacatggcagataagatccacgacctgttcgtaatcggcggcggcatcaacggttgcgggatcgcgcgcgacgcggtcggtcgcggctattcggtcgcgttggcggagatgaacgactttgcatccggcacatcatcgggtgccaccaagctcatccatgggggcctgcgttatctcgaacattacgagttccggctggtgcgtgaatcgctgatggagcgcgaagtgctctgggcgatggcgccgcacatcatctggccgatgcgcttcgtgctgccctaccagaaaggcggcatccgccccgcgtggctgatccggctcgggctcttcctttacgaccatctcggcggccgcaagctgctgccgccgacggcggtactcgacatgcgccgcgacgaggcggccaaaccgctgaaggcgctcttctccaaggcgtttgaatattccgacggctgggtcgacgatgcccgcctcgtggtgctcaatgcccgcgacgccagcgacaagggcgcgctgatcatgccgcgcaccaaggttgtctcggcgcggcgcgagaacgggctctggacgatcgagacggtggatacggtctccgggatcgcggcggttcaccgcgcacgcatgctcgtcaatgcggccggtccctgggtcgaccatgtgatccgcggcgccttcggcaagaatgaggcgcgcaacgtccgtctcgtccaaggcagccatatcgtggtcaagaagaagttcgaggggccgcgggcctatttcttccagaaccccgacaatcgcatcatctttgccattccctatgaggacgagttcacgctgatcggcaccaccgatcgcgacttcagcggcgatccgaaggacgtcaggatctcgcaggaggagacggaatacctctgcaaggcggcgagcgaatatttcaaggagccggtcaggcaggacgatatcgtctggacctatgcagggatccgcccgcttttcgacgacggcgccaccaaggcgcaggaggcaacccgcgactatgtgctgaagcttgacggcttcgtcggcagcgaggtcaacagggctccgctcctcaacgtcttcggcggcaagctcaccacctaccggcgtctggcagagcacgcgttggagaagatcggtgaggcgatcggcaccaagggggctccctggacggccaagagccatctgccgggcggcgactttccggttcaaggctacgaggcggaggtcaccaagcttcacaaggcctatccattcctcgccgcttcgcatgcgcgccggcttgtccgccgctatggcacaagagcatccgtccttctcggcactgccgggaaaatcgaggatctcggccggttgttcgggtccgatctctacgaagccgaagtgctctacctgatggcgcacgaatgggcgcgcacgacgaatgacattctctggagacgctcgaagaagggactgcatctcagccacagcgaagtggcccttctcgaccaattcatttctgagatcatccagcggcaggttgccgcgcagtgagatttttcggcgggccgtagcgcatcgatcatgccggccggccgcctgacatttgaggagttttgatgtcggacaagatttatccggtcaccaaaccggtggagagccatgcgctgatcaataaggccgagtaccaggaatggtacgaggagagtgtcgctagccccgagcagttctggggcaaacacggcaagcgcatcgactggttcaagccttacacccgcgtaaaggacacctcttttaccggggatgtctcgatcaaatggttcgaggacggtgagaccaatgtctcctacaactgcatcgaccggcacctcgcaacaaacggtgatcaggtcgccatcatatgggaaggtgacgatccatcgctcgacaggaaggtcacctaccgcgagctttacgagcacgtctgtcgtatggcgaacgtcttgaagaagcacggggtcaagaagggcgatcgtgtcactatctacatgccgatggtgccggaagcggcctatgcgatgctcgcctgcgcccgcatcggcgcaatccattccgtggtgtttggcggcttcagtcccgaggcgctgggtggccgcatcgtcgattgtgaatcgaccttcgtcatcacctgcgatgagggcctgcgcggcggcaagccggttccgttgaaagccaatgtcgacaaggcgatcgacatcgccgcgcgcggtcatgtcatggtcaagaacgtgctcgtcatccgccgcaccggcagcccgctcagttgggcgccgggccgcgacctctggcatcacgaggaagcagccaccgtttcggccgactgcccgcccgagccaatgaacgccgaggatccactgttcatcctctatacttcaggctcgaccggcaaaccgaagggcgttctccacaccaccggcggctatctcgtctacgcctcgatgacccacgaatatgtcttcgattaccagcacggcgatatctactggtgcactgccgacgtcggctgggtcacgggacactcctatatcgtctacggaccgctcgccaactgcgcaacgacgctgatgttcgaggggatcccgacattccccgatgccggccggttctgggatgtgatcgataagcacaaggtcaacatcttctataccgccccgaccgcaatccgttcgctgatgggcgccggcgatgatttcgtcaaacgatccagccgatccagcctgtggttgcttggctcggtcggcgagccgatcaaccccgaagcctgggaatggtactatcacacggtcggcgacgggcgctgccctgttgtcgatacctggtggcagacggaaaccggcggcatcatgatcacgccgctgccgggtgcgaccgacctgaagccaggctcggccactcggcccttcttcggcatcaggccggagctcgtcgatgccgaaggcaagcccatcgaaggggccgccgacggcaatctctgcatcgccgacagctggccaggtcaggcgcgttccgtctatggcgatcacaagcgcttcatccagacctacttctccacctacgagggcaagtatttcaccggcgacggctgtcgccgtgatgccgacggctattattggatcacaggtcgcgtcgacgacgtcctcaatgtctccggccaccggctggggacggcggaagtcgagtccgccctggtttcgcatcacctcgtgtccgaagccgctgtcgtcggctatccacacaacatcaagggccagggcatctattgctatgtcacgctgatggcgggcagcgaagggtccgaggagttgcgccagcagctggtcaagcatgtccgcgcggaaatcggcccgatcgcgtcgcctgataagatccagttcgcgccgggcctgccgaagacccgctcgggaaagatcatgcgccgcattctgcgcaagatcgccgaggacgatttcgggtcgctcggcgacacctcgacgcttgccgatcccgctgtcgtcgacgatctgatcgtcaaccgccagaacagggccgaggcggcctagaccgaaggaaaggactatcccatgagactgatcctgatgggcccgcccgggtccggcaaggggacccaagccaagcgcatctgcgaaaagctcggcatcccgcatctatcgaccggcgatatcctccgggccgaggtcaaggcgggaacgcccctcggtttggcggtcgcggccaccatggcagccggcgggctcgtttccgacgataccgtctcggcgatcgtcgccaaccggattgccagtccggaagctcagcgcggattcgtactcgacgggtttccgcgcacgatttcgcaggcggcgtcgttggatcaatcgctcggggagcattccctgactgctgtcatcgagctcgtcgtcccggaggaagaactttacgaccgcatctgccgaagggcggcagagtctgccggcgcacaacgcgccgatgacaatgcggcgacattggaactgcgcctcaaggcgtatcgggccgagaccctttcggtgagcgagttctacaagggtcggtcgccctactttcaggtcgacggcctcgccgttcccgaggaagtgaccgcccggattctggagatcctggagtcggccgcggccgaatattcctgagacattactaattcgagatcaattttaccggatattcattcactcagaataattattatgggacctcgttatcttgggtggagaatcatgagcattcattttgacttcctgctgttgcgcggaccgatccggactaaaatcttttgtctgctgacgccgatactgatcggcatcgcaggcttgagcctcgtcaactatctctcaggcaacatgctgaatacccagctcgcgagcagttcgagcgggatggtcacgctgtctgcgatcaaacaagcccaggacgggatgaactccttcctgctcgaggcgaccgaggccaagcgcgatgcgctgaaggcgctgctcgcagaccagagcgctaagatatcgacgagcctgtccttcgctcaagagcaggatgaacggcagagcctggttgccgccgggacgattgccgaagaggtctccaggacgatcgacggcctctgggacatgcacagcgacgagaggaaactgcgggaagggatttccagcgatctcgcaaccctgtcggatgtgcagtccaaactgcagacctatctgaacattcccgccgatcaggcggcagcacaagcggcgaccgccgaaacgctgaacaagatcaattccatgaactacgaacttcggatcgccgcttccgactttctgggtggaatgaacgacgataccctcaagaaggtgaagggccgtctcaagggcctgggcttctatctgggcaaggtcaaggaacagcatgccgccaacggtcctatccaggaactggccagcaaagccatcgacgtgatcggcgggacctcggagaggttcgaccagctcctcgtcaaggtcggagaacgtgacgccgccttcaaggctgcgagcgccagcatgaatgacgcctggaacaagatccttctattcgccgacatccagcgcggccatgcctccgcggcccaagaccaggcgcaaaccatatccttagtgacgaccgtgatcgccctgctcttcggctgcgtcgccggctatctgctgctcagaaccatcaagtctccgatcgaagcgctcacggcctccatgaaggcggttgcatcaggcaagctcgatgaaaagatcggcagcgtcgaaacgcgcgacgagatcggcgagatggcaagggcgcttgatgtctttcgccacaacgcgctcgaaaagatccgcgtggaaaatgaggcggaacagtcgaggtcactcgcgcgccaacagcgccaggaagacgacctccgcaagacccgcgatgcggctgccatcagtaacgctgtcgaggcggttgcatccggcctgcacaagctggcgagcggcgatctgaccgtgaccatcggccgtcccctcgatggtgagctcgatcagcttcggcaggacttcaatgcctcgatgctgcacctgcaggcgacgatgcgccagatccgcgacaatgtcgaaatgatccagggcaacggcaaccagatggccgaggcggccgaggatcttgccaaacggactgagcagcaggctgcttcgctcgaagaaacggcagccgccgtcgacgagatcaccgtcacggttcgctcgtcggcggaacgtgccaaggatgccgaccagatcgtccgccaggccaagcagagcgccgacgattcagccatcgtcgtcaacaatgcgatcgatgcgatgggccggatcgaagaagcctcccgccagatcgagcagatcaccggcgtcatcgacgagatcgccttccagaccaatctgctggcgttgaatgccggcgtcgaggcggcacgcgccggcgatgcgggcaaaggctttgccgtcgttgcccaggaggtgcgtgaactggcgcagcgctccgccaaggcggccaaggagatcaaggtcctcatcaacaagtcgacggccgaggtcaataccggctcgcatctggtccaggaaaccggttcggtccttgcgaagatcagctcgcagatcgtcacgatcagtcagcatgtcgagacgatcgcccgcggcagccacgatcagtcgagtgcgctgcagggggtcaactcgaccgtcaatcagatggaccagatgacacagcacaatgcggctatggtcgaggaaacgacggccgcgagccgcgaactcgcctctcaggccgacagcctgctggccctggttcagcaattcaggatcgaaggaaatgcacgagaatttgggttctcaaacgccgaggagttgtcgcaccaaagaccggccagccagagcgcggcgtgaggtcgccaccgaattacattggccggacagaactgcgtctgaagcggagtaacgaaatcggatctcactggatttacgagacaggttgaaacatcgacatgacaatcacaccggacatagaacttggcgcttatctccacgagacgaaagtcgatcctgccctggcaagcttggttgaaagcatagcagcctcagcgatcgttgttgccgatcacctgaaggaagcagcctttcagaaccatataggcagctccggcacgacgaatgtccagggtgaagatcagaagctcctcgatgtcctggccgatcgtgtgtttcgcgaaacatgcggcgaggcggtctcgcttgctgcctatgtttccgaggaggcggaggaggtcacgtggttgaaacctccagccgctggcgacctcatcctttacgtcgatccgctggacggctcatcgaaccttgaagtcaacctttccgtcggttcgatctttgcggtgagtcaggtccaggcggacggcgacaccaatgttctacgcaaggggcgagagtatctctgcgccggctatgccatctatggcccctcgacgctcttcgttatcacattcggcctcggcgtggtcggcttcacgctggatccgtctgacgggcaattcaaactgaccaacgcgcgcatgcgcgtgccgacggaaacgaccgagtttgccgtgaattcgtcgcgccagcgtttctgggatgagccgatccgacgctatgtcgacgaatgccttgcgggatcggcagggccgcgcggacaggacttcaacatgcgctggaccgcctcgatggtggccgacgtccatcgcattctgacccgcggaggggtgtttctctatccggcggacgagtccaatcgccgcgccggcggcaagctgcgcctgatgtatgaagccaatcccatggcgttcctcgtcgaggcggccggcggtgcagcatccaccggaaccgaagacatccttcgcatccaaccacaggctcatcatcagcgcgtgtcggtgttgctcggctcgagcaacgaaatccaacgcctggtgcaatttcaccaaatccatcactcgcaagaggagatcggctcttaaatggctctcgtcacccttcgtcaattgctcgaccacgccgccgagaacggctacgccatcccggctttcaacgtgaacaacatggagcagatgctcgccatcatgaaggctgctgatcgtaccgacagcccggtcatcatgcaggcaagccgcggcgcccgagcttttgcaggcgacgcgacgctgtcgcatctgatccgtgcggcgatcgagatgtatccgcatatcccggtgtgcatgcatcaggaccacggcaattcggcgtcgacctgcatgtcggcaattcttgccggcttctcctcggtgatgatggacggttccctctctgaagatgggcgcacgcctctcagcttcgaaaataatgtcgccgtcacggccaaggtttcggagatggcgcatctggtcggcgtctccgtcgaaggagaaatcggccatctcggctcgttggaaagcggccgcggcgaagcagaagatgggcacggctttgacggcgagctcagccgcgacatgcttttgaccgatccggaagaggctgccgagttcgtgcgcttgacgaaggtggatgcgctcgccatcgccatcggcacgtctcatggcgcttacaaattctcccggaagccggacggcgacatcctttccatcaagcgcctgaaggagatccacgcccgcctgcccgatacccatctcgtcatgcatgggtcgtcgtccgtgccccaggaattgcaggaactgatcaacgcgcatggcggcgaggtcaaaccgacctatggtgttccggtcgaggaaatccaggaaggcatccgccacggcgttcgcaaggtgaatgtcgacaccgaccttcgattggcgttcacgggggcgatccgccgcgtctttgcccttcatcccggggagttcgatccacgcaaatacctcgccccgggcatcgaggcgatggcagcggtctgcggcgaccgatacgagcagttcggcgccgccggacatgcctccgccatcaagcccttgccgcttgccgagatggcgaagcgatatagccactaaccgggggcaagaacttgagtaacactccccgccggctcatcgtcggcaactggaaaatgaacgggcttacggccgatctcgccgagatcgaaaaggtcgcctggaacatcggcgagctgaatgcggatgtggctatatgtcctccggcaacgctcctgcaatccgccgtgaggataatcgccggaagccggcttcttctcggtgcccaggattgcagcgctcaggaagctggcgcccataccggcgacatatccgccaggatgatcgccgattcccgcgcccgcgtcgtcatactcggtcattccgagaggcggcaatatcagggcgagacggacgcgatggtcaggcgcaaggccgagattgcggtgagcgccggcttgatgccagtaatttgcgtcggtgagacagaagcggagcatctccgccaggagacgcttactgtcctcaaaaaccagctgcagggttgcctgcccgccgaaatgaacgagctcgccttggtcatagcttatgagccggtctggtcgattgggaccggtcggctgcccgaacaaagcgaaattctcgccgcccatgcctgcatccgatccagtctgatcgatgcctatggatcgatcggtgcacagctcaggatcctctatggtggatccgtcaaacctgagaattcggccgagattcttgctcttgaaaatgtcgacggtgttctggtcggcggcgccagtctgcgcgcggaaagctttcttcggatctgcgaggcaaccgggaggtaggtcaccagtcgttccgctgcggaagtcaggggcaaacccatcgggcggatcgttcgccctgttgctcgaggatgaaaataaacaccaacgaaagcaggttggtcatggaacattggatgctttcgcccatcgaaaagacctgccttcgatgggtgtcgatgggaaagactgttgatgaaatcgccctgctccaaggcagaagcgtcattgaaatcgaaagctatctcgagcaagcgcttgctgcactcgaggcgagttcgatgcaggaggctctcgagaaggcaagcctttcggagcccgactgatgttggccgcagggcggcgagcagcaaacccacgacctttcaacgacagggatggcgatgaaatgaccaatcatgtgaacaatcagagcaaggccaaagcgccgagcccgatcgatgtcgaggtgggagcaagcgtgcgcggaatgagccaaagcacactcgccgaggctttgggcgtgacgttccagcaagtccagaaatacgagaagggcacgaaccgcgtcggcgcgagccgtttgctcaatgtcgccactctgctcggtgtgccggtgtcgtatttcttcgacagccagagccgtgatggaaaacccgatgggctgacaggcaccggcgccgagatggagctcagcgccttcctcgataccgacgaggggcgagacctcaacgtcgccttcgccaggatagcaaggccggcactgcgccgtcaggtcctatccctcgtcaaggccatggccgcgacggatgtaaagggttcccgcgggaacgcctagtttggtgccgctccggttatgcggcgaaactcaactcctggagatgcccattgcagcatgctgcactccgacatggcaacatcgcgcaggccggcccggttggtcagctggatcgcgatcacgtgtcttgcgtcggggacagccattacatcgtcggccggttccacgcctggaaaggaaagtgccattcagccctgaagctggcgttcgatggcgcgccagacgcttatttgctttacctgcccctatccaccacgcctgggacacgttcgggggcactgcgcctttcgacggcacaggcagttggttttctggaggatctcgctcagttcgatgagctgacccctcatgaacattccagctatatcggcctctccttcgcaaagtcggcgatggtgcaacaggtcagtgaactcttggatgggcctgtcacggcagaccttcatttcgaccgcatcgtcgatctgaccaccgagaagggtctgcggctggccgcactcggccatctcgtatggagctgtcttaatctttccgacgcggatcgattggcgccggctgccatcgagcggctgtttgagtcgacgatgatcgcacttctggaggttgttcccaatagctacatgccgcggctcgagcggccggtctcgccggcggtgccccggcaggtgaaacgggcgatcgagtatatgcatgccaacctgtcgcaacctctcactgttgcgtcgatagccagcgagaccggtacgagcgtcagagcattgcaggtcgccttccagcggttcaagggcacaacgcctttgggctatctcaaaacgatccgcctcgaagcagcgcgccgagcgctggtcgacgataccggctcgcggtcgatcgccgacgcggcacgcagtgcagggttcacccatatggggcggtttgcggccgtctactatcaggcttttggcgaaacgccgtcggaaacgatccggacgagatagattgccagtcaacggcaatgtcgaaagcggaaaccatcttcgtgttgcggaagtcagccgcgaaactggcatggtatgaaatgcgtgcgcgaaccgttcatctcccccggaagcagcccaatcccgctcttttgtgatggcgtcctggcccggcgccggatcttccacgatcaacccgttaagggtccgctagcaagctgcggccgcttcggcttcgcctcgcggtgatcgcgcccgtcgccgggccttttgaggagccatcgagcgggattggcccgctcccgcaggagcctcttatatgtcgcacgatctttccctcgctcagtcccacgccttccagctttcccgcgacctgatggtcccggtcaccgtcttcgaagtcgacggcgaatatggcgtcctcccttctgacgagatcgacgccggtgacgcccttgagatcgtcaatgagttcttcccctggccggctcattgagccggccgccagtgccttcggcgtgccgcttgcgcgcggcaggccgcaagggaggctgcgccgcggccgggtattgcatgatccgacaattgtcagccgcgcccttgcggcctttgctcttcgcggcgggtggagcgcgcctgcgaagcgacgggcaagaaaggcaatgaggaaaagcatggacagaaaggaaatagaggcgctgcgcgaccaggtgagctgcgcggctgttcttgagcaggcgggcttcgccatcgatctaaaggagagtacccggcgggcggtgaagttccgccggtcgggcgaaattatcatcgtcacccatgacggtcgcggatggttcgatccgctcggcgatgcgaaaggcgatgtgttcggacttgtcgaacatctcgatcatgttggctttctcgaaggcgccggaagggtcgccggccttgttggttttgcgatcacggagccggaatggcaggcgccgaggcctgaccgagacctcgatctttctttacccgagcgttggcaggcacgccgccggccgtggcccagctcgtcgacatgggcttatctgaacggtgagcgcttccttcctgccactctgctccgagccacgatcgggcaagaccgtctgcgggaaggcccgcaaggcagcatgtgggcagcgcacaccgacaatgccggagttgtgaccggctgggaggcgcgcggtcctgaatatcggggatttgcctccggtggaacgaaggtcctcttccgtctgggaccggacccagcgttgcgcctggccgtgacggaagctgcgatcgacgccatgagccttgccgccatcgaggggctgcgcgatggaaccgtgtatctcagtaccgggggcggatggtcgccgtcgacggaggcggcgcttcggcagatggcctcgcgagcagatagtctcctcgtcgccgcgacagacggcaatccgcaaggagagatgtttgccgagcgcttgcgggcgctcgcggataccgtcggctgcgactggtcgcggctccgcccgcccgaggaggattggaacgaaaccctgaaaatcagggagaaagaaaagagggaaaggaaggaaggcggcgtgccgcattcgcgccgcccgcgtcaagggaagcttcgcccgggcgagccggcccttgacccggccggtcgcgatgccggcggcccgggaggtgtcatgaaggactgaagaggatggcaaggtcggaaggacagtgccgcacttcggtccggaaccatctccaaggagccgcagatgtatccctctcccgcaatccgcaaggtcttccacggcgttgcctcacgccagcaaatgttccggatgttcgatcggcacgctcaacgtccgaaccgttgggacggtgacgcctcgctcctctattccggcgaatggttcgagatcgccgagaccgagcacgactatatgttcgagatcctgccaccgctctggatccgcgggtcgatgttcgccatgcgcgagtatctgacgggttcggtgacatcagtgttcttcgcattgcgcatcgatggtgtcatccgacatttccacggctattgcgatctatcggacaaaggcgccgtcgagcgcatgcgcgtggcaatcatcgagcgtgagagccggccggtgcgcgccatgacgcgcgaggaacgcctggagcatatctggagcatcacggcggacgactatcgtggctatgccggcgatcgctgggacgaagctgcgcgcggcaagcgcacgatcatgctctacggcggcgcagtgggcagcactctgaaactgctcgacgagctgaccgacgacgagatcgcggcgaagctgccggtgcagctgcgccacctcccctcgccgattgccgcatgagggaggcacactatgctttccttcccgcttacatccgtccgcgaggtcgtcgcccgcagtcgtgccgacgccgaagccaatggcggctttcgtaacccctactacggcctgcgccctggcaaggacgagaagcccggcctctggctcgtcggcgaccaaggagtctacctcctgtcgaacggcaagctgcccgatggcgccaagcctttggtcgtttatgccgaggaatgcgatccccgcaccaatgacgactggttcgcagtcaaacgccggacattcggcggcgatgacggagtcgatttcgtcgatgcggaacagctcgaagcgatgatggcggccgcgccggaggcgacgcacctgcgtatcgcattccttcaggactcgatgcagctcttcctggtcgcgaagccctaggcaattcgcgaccagtccggcccgtttggccacctatcccaaacccttgagctccctttaatccccgcaagtgcttcccgcggggtgatgacgctcgccattttccgaggaaacctccatgagcaacgatcccttcactctcgacatgttcggcagcagcgcgctgtcatcaggcctcggcctgggcgtcacaccgttcggcggcttcgatacggtcgcggccaacgacgatgacccggaaccgacgccgccctctccctccccggccttgccggccgcggcgatagaacgtccggcgccccggcgccagggcaaccggtgcaacttctacctcgacgatgcggatcggggcttggccggatcctggaaggatcgcgctcgcgccaatgttgcggcgatcctgatcgcgaacaacatcgagaagcaggatcggccagccaacgcgaaggagcaggcgcaactcatccgcttcaccggcttcggcgccagcgaactggcgaacggtatgttccgccgccccggcgaagtcgatttccgggccgggtggggcgagctcggtggctcgctcgaaagtgccgtttcagatgccgactacgcgtcgctcgcccgctgcacgcaatatgcccatttcacgccggagttcatcatccgggcaatctggtcgggcttgcagcgcctgggctggtgtggcggccgcatgctcgagccgggtatcggtacgggcctgtttccggctctgatgccggcggcctttcgcgacaggaccttcgtcaccggcgtcgaactcgatcccgtcacggcccggatcgtcaagctgctgcagcctaaggcccgcatcatcaatggcgattttgcgcgcgccgatctggcgccgatctacgatctcgccattggcaatccacccttctccgatcgcaccgtccggtctgaccggacctatcgctcactcggtctcaggctgcacgactacttcatcacccgttcgatcgacctgctgaagcccggcgcgctcgccgcgttcgtcaccagttccggcacgatggacaaggccgacgcgaccgcgcgtgagtacatcgccaaaaccgccgacctgattgccgcgatccgattgccggaggggagtttccgccgcgatgctggcacggatgtcgtggtcgaccttctgttcttccgcaagcgcaaggtcggcgaaccgacaagcgatctgtcatggctcgatctcgaggaggtgcggcccgaaagccaagacgagggcgcagttcgcgtgaaccgctggtttgcagagcatcctaatttcgtcctcggcgatcatgccctgacctccggaccgttcggcgagacctatacatgccagccacgcgctggcgaggacctgcaggcggctctaaagaacgtcgttcgcctgctgcctgaaggccgctatgacggtgagccgaccgcaatcgacgtcgacctcgaggacgagctcggcgagatcatcgatcttcgccccggtgacgccaaggtccgtgagggtagcttcttcatcgataacaggcacggcctgatgcagatggtggacggcgcacccgtggaggtcaaagtccgcaaggggcgcaccggggacggcatcccggaaaagcacgtcgggatcatcaagaagctgatcccaatccgcgacgcggtgcgtgaggtgctgagggcccaggagcaggatcggccgtggcgtgatctgcaggttcgcttgcgcatcgcctggtcgagcttcgtgcgtgatttcggtccgatcaaccacaccaccgtctcgatcagcgaggacgaggaatccggcgaggtgcgcgaaacgcaccgccgtccaaacctgcagcctttcctcgacgatcccgattgctggctggtcgcctcgatcgaggactacgacctcgacaccgataccgcaaaaccgcgcccgatcttttccgaacgggtcatcgcgccgcctgcgccgcccgaaatcaccagtgcggcggatgcgttggccgtggtgctcaacgaacgtggccgcgtcgatgtcgagcatatcgccgaactgctgcacagacatgccgatgccgtcgtcgacgagctcggcgatgcgattttccaggatcccgccgatggctcctggcagacgtcggatgcctacctctccggtgcggtccgcaccaagcttggtgtcgccgaagctgccgcggcactcgatccagcctacgagcgtaacgtccgcgcgcttcaggcagtccaacccgccgatcttcgcccgtccgacatcaccgcacgtctcggtgcgccctggattccggccagcgacgtcgtcgccttcgtgaaggagatgatgggtgccgagatcaggatccaccatatgccggaattgggcagctggacggtggaagcacggcagcttggctactgcgccgccggcacatcggagtggggcaccagccgccgtgatgccggcgagttgctcggcgacgcgctgaacagccgtgttccccagattttcgatatctacaaggatgccggtggcgagcggagggtcctgaacgtcgtcgataccgaggcggcgcgcgacaagctgcagaaaatcaaggaagccttccaaaactgggtttggaccgatccggatcgcaccgaccggctggcgcgggtctataacgaccggttcaacaacatcgcgcctcgaaaattcgacggatcgcatctgaaacttcccggcgcctctggcgcctttgttctttatgggcaccagaaacgcggcatctggcggatcatctcctccggatcgacctatctcgcccacgccgtcggcgcgggcaagacgatgacgatggcggccgcgatcatggaacaacgacgtctcggcctgatcgccaaggcgatgctggtcgtccctggtcattgcctggcgcaggcggcgcgggaatttctggcactctatcccaatgcccggatcctcgtcgccgacgagaccaacttcaccaaggacaaacggcttcgctttttgagccgggcagcgaccgcgacctgggatgcgatcattatcacgcactcggccttcaggttcatcgccgtgccgtccgccttcgaacaacagatgatccacgatgagttggagctctacgaggatctgctgaccaaggtggacagcgaggaccgcgtgtcgcgcaagcgcctcgagcgactgaaggaaagcttgcaggaacggctggaagggctcgcgacccgcaaggacgatctgctcacaatctccgagatcggtgtcgaccagatcatcgtcgacgaggcgcaagagttccgcaagctttccttcgcgaccaacatgtcgacgctgaagggtatcgacccgaacggctcgcagcgcgcctgggacctctatgtgaagtcccggttcctcgaaacgaagaacccgggccgcgcgctggtgctcgcctccggcacgccgatcaccaacacactcggtgagatgttctcgatccagcgcctgctcggccacgaggctctcgccgagcgcggcttacacgaattcgatgcctgggcgtcctgcttcggcgatacgacgaccgagctggagatccagccgtccggcaaatacaagccggtcagccgcttcgcgagcttcgtcaatgtgcccgaactgatcgccatgttccgggctttcgccgacgtcgtcatgccggcggatctccgcgaatacgtcaaggtgcctgatatctccaccggccgacggcagatcctgaccgtcaagccgacgccggcgttcaaggcctatcagcagatcctcgatgcccgcatcaaggcgatcgagatgcgcgagggaccggctgagcccggcgacgatatcctgctctcggtcattaccgacggtcgccatgcggcgatcgatctccgcctcgtgataccggccaacgacaatgaggaggacaacaagctcaacctcctcgtccgcaatgccttccgcatctggcaagagacgagcgacgatacctacgtccggccggacggcaaaccctttgacctgcccggcgccgcgcagatgatcttcagcgatctcggcacgatcaacgtcgagaagacccgcggcttttccgcctaccgctggattcgcgacgagtttgtgcggctgggcgttcccccgtccgaaatcgccttcatgcaggactacaagaagaccgaggccaagcaacggctcttcgccgacgtgcgcgccggccgaattcggttcctgatcggatcgtcggagacgatgggaacgggcgtgaacgctcaagcgcggctgaaagcgctgcatcacctcgatgtgccgtggctgccgtcgcacatcgagcagcgcgaaggccgcatcgtccggcagggtaatcagcacgatgtcgtcgacattttcgcctatgcgaccgagggcagcctcgacgcttccatgtggcagaacaacgagcgcaaggcccgcttcatcgccgccgcgctcagcggagatacttcgatccgccggctcgaagacttcggtgaagggcaggcgaaccagttcgccatggccaaggcaatcgcctccggcgacgagcggctgatgcagaaagcgggtctcgaagccgatatcgcgcgactggaacggttgcgcgccgcccatgacgatgaccagtatgcggtgcgccggcagatgcgcgatgccgagcgtgacatcgagacgtcgacccgccgcatcggcgagatcggccaggatatcggtcggctcgttccgaccgccggcgatgccttcgcgatgaccgtgctgggcaagcttcaccatgagcgcaaggaagccggtcgcgcgctgatgaaggaggttctcacgctcctccagctccaacaggagggcgaggttcacctcgcatctatcggcggtttcgatcttgtctatgagggagagcgcttcggaaagggcgacggctatcgctacgccaccacgctccagcgcacaggcgccgcctacgagattgaccttgcggtcacagtgacaccgctcggcgccatctcccgcctcgagcatgcgctcgacgggttcgaggaggaacgcgagcgttatcgccatcgcctcgatgatgcgcaccggcggctcgtctcctatcgctcgcgcgaaggcggcactttcgccttcgccgacgaacttgccgaaaagcgccgacagcttcgtgacgtcgaggacgctcttgccgccgcgtcagttcagaacgacgccgcctcggcggagtctgcttgaatggaatcgcggttttgatgcgacgcagcatttgcatagctgcattgcacaatatttgctttccttccgaccgaaatttgagcatagtgctcacagctgatgcacatggcggttttcctcccagtgccgccgcagcagctgttcccctctggaggtttaaattaccttcatacctatagggcccgagttttctcgtggccctctttttttgtcctgatttccgttcatcgaagcgacccctacgacggtcatcctcgtcgcggttttcccccgctcaggtaatcacctcgacgcgctccatcttttcgatcagccgcccgctcatatcctccgggtcgttcaggacggtcacgaagtcggagaggctcggattcttcaaaccgactttgtagatcgcaaccccgcttcgacattctcgtccatggccttcagcccctcgaaatgtcgggaggcctcctgccaggcgagccccaaagtctcggtgaacgcaaggatctcgtctgttcccggaacgacctgataggcaaatatctcttttgtatcgtgcatcgaaacctccttgagctgcgacagcctaaggcgcgtttccggttgctgtgaactatcaaaagtgtgagcggcagtttccggaaggagggaggacaaaaagaaggaagagggaaaagaaaccggtcgcagatcggtcttccagtcgccgcttgcgctcaaccgccgcctgcgcatcccggccactcgtcccgcgcagggctgttagccccgctcggacatcgcagcagggacgctcggccgcagttgcgccgggccgcccgccccgcggtccgggaggtgtcttcgaaagaaacgaagacaggaaggaccggcaagcgagccgtgtcccgcatctcggaagaggaaaatcccatgcacatcatgaaggtcgatccgcgctcgttgaaggacaacccggacaatactcgtcagtcgaaatccaccccgcaggctgatgcgctgctgctcgcgaccatcaaagccgtcggcatcatccagccgcccgtcatctttccgcaaagcgatggcggaaacggctacgtcatcgaagccggccatcggcggacccgcatggcgatcgccgcgggccttgaggaaatcgaggttctcgtggtcgaagccgctaacgataatggcgccatgcggtccatggtcgagaacatcgccagggagccgctcaaccccgtcgaccagtggcgcggcatcgaacgcctgatcgcactcgactggaccgaggaagcgattgcggtcgcacttgccctccccgtccggcagattcgcaagttgcggctgctcgccaatgtctttccggcgatgctcgaccaaatggcgctcggcgacatgccgaacgagcagcagcttcgaacgatcgcggcggcacacctcgatgagcagaaggaagtctggaaggcgcagaagccgaagaagggccagcctgccacgtggttccagatcgccaacgcgctgagcaagacccgcatgtacgcaaaggatgcgagcttcggcgacgatctcagggaagcctatggcatcgaatggatcgaggatctgtttgcccctgccgatgaggacagccgctacaccaccaacgtcgaagcctatctcggcgcccagcaggagtggatgaccaacaatctgccgaagaagggcgtgatcgccgaggtcacgcaatggggtgacgtaaagctgccgcagaaggccagccgcgtttatggcaagccaggcaagggcgaccacaccgcaatgtacctggatcggaacggcaaggttcagaccgtgcattaccggatgccggaggagaagaagacggcgggcaagagagcggtcgttggaggtggtgccaccgctggcgacgatgtgatcgacgcgccgaaacagcgtccggatgtcacgcaaaagggccacgacatgatcggtgacctcaggaccgacgcgctgcacgaagcgctcgctcgcgcgccgatcgaggacgacacgctgacggcgctcctcgtgctcgccttcgccggcttgaatgtacgggtcgactccggggcaaacgacaccgtcttcggcacgaagcggttcgctcgccatgcggttcggttgctcgactctgacggtaagctgtccttcgagatcgacacgttgcgggttgccgcccgctcgatgctggtcgatgtgctctcttgccgccgcggcatgtcgaacagcgggatcgtgtcacgtatcgccggcgaggccatcggcgccgatggatatctcccgaacatgggcaccgaagatttcctgctttgcctgtcgcgggcggcgcttgaggcgtcgtgcaaggacaccccggttctgccgcgcccgaaggtccgcgagacccgcgcagcactcgtcgagcacttcaaggaagggcacttcgtccacccggcagccctgttcgcgcccgatccgaaggaacttgccgacctgatcaagaaaggcgagatcgtcgaagaggaggacagcgtcaccactgaagaaacgagcgatggtcttggcgaactcgcggacgacagcgccgccggcgaggccgccgaacttgacgcccccgatccggaggccgacgacggggctcctgacgaggacgaaaccgcctacggcattgcggccgaatagcctcccttcccttctcatccgatcgacaaccgccgccggccatcaccggcggcggcttcgtttccatgaaccgcagaattccaaggagatgtcttatgtctgcgtccctgatctacgacctcgccccgatcggctccatcgtcgcctggtccgacggcagccctcggccgcccgagcgtttcaagaagaagctggcggcctggcaaacccgcaacagcaaaggccgcctgatccgcaaggagggtccgcgccaatccggaaattacgcctcgcccgggcatttcacgctgcatgaggctgatttcggcggaaagaataccgtcgtcatgcgcattcaccgaaccttcggtctcgattccgatctcgccttcaaggttctcgaacgccccgcactcggttctatccgcctcttcgatcgcgccggtgcgaacgcggagcttgtccatctcgccggcaatcacgaggcggcggtggcctggctgaaagagcatggatacccgaatgccatcctcgaagaggtgaccgccgacgaggtcgcggcggctcatgtcgaagggagggttgccgcatgagcacgcccgatcttcaacacgacagggttcctaccgccgacgactccgcggtgaaattcggcgtcagcgcggacggctttccggtcgcccggatcgccgataccttcctggcaatggtgccggcgcgcgatggcgccagcttcctcgcgagcgcctggcgcctcactcgcccgctgtcagagctgacgcgggaggatttccacggtcacgaagggcgcctcgaagatgagacagcgttccgcgcgcgcgtgttcgagaccgcgcggcacagccatgaactatccgcgctcgggcggatccagagccgcatggcagcgactacgccatggggtctgtcgcagctcgcgacgatctacgccgaggggatcgtctcccatatgaccgccggtcatggcgggtttcatctgtcggccgaacggaatgcccgcgtccttccgatgctgcgaaagtccttgccctggtacgaggaggacgcagaatgggcgattgtcgccctcaccttcccagatctcttcacgtcctacgagcgcaaatgtgccgatgagacgatccgcaatagctggccgtccgcctgggaggcgatccacggccgcgaactccagcccggccaatcctggacaaaggaccgggaagccttcgagcgcaagcatgccggcgactggatcgtgatctccgcgatcttttccagccgccatgccgacatgacggaggtcatcgccacgcgaggcggccggcgcgatgggcgggtggaggagatgcgctttctcgtgccccgcgccgagtatgccgcgcgcgaccgcttcggtttcgtcatcgatcctgaccgtcataatccctgtgacggtccttccagttttgtggggtggcaagggagggatgcgtgatggctgcaatgccaatccaccatgcgcaactggcgcgtatggaagaagcgcggcggcagacgcagcgccagctcgaactgatcgatcgccaggtcttgcgccggataacatcgatcctgccacagctcgcgcgccggcaaaccggatatcggcgcggaaaggcgccggatacgggcttcttcctcgaacgttatcgcaacaatctcgccgccctgacagcggagcgtcagccggaagttgacgcgctgacacgaaagttggctcggcaggatgcagcgatagccgcctttcgcaaacggttcgaacccgttggcgacgcggctcagccacgagcggaggtctagcgacatgggtacgatcggagacctcgaacggagcgccggcattgggccatcgtccgcggaacgcaccgcgttctggcagcagttccaccacctcaacggaaaggcgtgcctcgacgcgggcgttgcggagcttaaacgaatgatcgccgcgagggaggaacaggctgacgttgcctcgagtaagcagcgcgctgttccgaagcgcgaaagacttcctcctttgagcggtgaacaggaagccgcgctccaggcctatgccgcaagacacgggcgtcgctggaagagcatcctgaacaacgtctggatgggtggcgcgccctatgacgatggcgggacactccgcggtcttcgaaacacgcacggtccgagctggctgcaatattatcggctgcccaagccgaaaccctcggccgagaccatcatcgcgccaattgagcgtgcggcgagttcgggaagtgacgacgtatagcgtcccggcagccatcttcctttcagtacctggttggaccagaccccgtgccgatttgcccttcggttttgctgcggtctgaaccagcggccgttcgcttcaaggccgctatccgcgccgcccggcggccggaggcgccgtccctcacggagcaggcttgcgggcctcgcagggcaggatgccccgcttgcccgcaaaccggctccgctcagcctgtcgtctccggaccttgaagcgcccgtcttccgccggttcggggcgaccgcaccgaagggcaaatcggcacggggccggagccgcttcgaggttgaaaggaagaaatcatggcaaagcccgctacctcccctcgtcaatccgctcgcgtcgtggctctgcgcaaaggcgcaaccgtcgaaatggtccggctcacatgccccgacagtgcccaggcgctgaagatcgccgagagcttcggaaccgcgatcgtcgacagcgacggaatccgcgatctccatgagcgtctgatctccgagacggccgatgctctgagcgatggtctcggcgaaaaggccatgcagatccatctgcagcggatcgtcggcgccttcgtcggctcggcgcacggcgcaggccaattctatagccgcgccgtcaccgaggcacgcgatgccacggccaaggctgccaacgacgcccgcgacgaggacctcgacggccctgtcggctacgacagtgctgcccagcgcagacgcgagtttgccgccgacatgggcgtgcaggctcatgcgcttcgggtggccgcggagggcgccgttgcagcctacaagcaaatcgtcggtgaggcctggaaacccttcgatcggcccgtcgaaaacccaggtcactctcttgatcgcaaggcggccgaagcacagatgtcggccttcgactgagcgctttcgggcggggctccggccccgcctttttccatgtcgggaagcaagcgtgcctacggccttggaaaaggtcgcccgatgatctacattattttcgagatttatctacatggagacgacccatgccgatcaacgtcaacaatccggaagcggacgcgctgacgcgcaagttcgccgaaatggccggcgtcggcattaccgacgccatcgtcattgccatgcgggaggcgatcgagcgtcgcaatcgcgcggagacgccactgcagactgctgcgcggctgcgggaaaagcatggggtcgcgatgagcgacgacgtccgcaagcctcttcctcctgaagccttcgacgaaatgtgggatgacgcctgatgttcgtcgatgcctgcgccatcatcgcgcttctctctgatgagccggaagcggcgcgcgtctccgacgccgttgcttctgccagacatcccttcacatctccggtcgccattctcgaaacagtcctcggccttgcacggcccgacaagttcaatcttccagtgcccgcggtcgaaacgatcgtgatggaattcctcgaagcgcgggaaatcgagattcgcgatcttccgcccgcatccgagacgacgaggctcgcccttgtcgctgctcaccgctatcgcagcggccgccatggcctgaacctcggcgattgcctgcattatgcctgtgccaaattccatggcgtgccgatcctcgccactgcggatgagttcaggtcgaccgacctcgaaacaattccttgaatctcctgaagcagtgacgccgagatcggcccgtcgcgaacccgtccggcttttggtcctggcggagcgaggcgttcgggcaacggcttcgccgtcctccacgtccgttccggcctttcggtgccctcacccctttccgctccgcactttggaccgccgtgacggggtcgcgatcggcgcgacctccttgaattggaggtttgaaatgagcaggaaggacgaaggccagcgggccgacatctacacgcggatcactgacaagatcatcgaggatctggagaaaggagttcgcccatggatgaagccatggaacgccgcgaacacgaacggtcgtatcacccggccgcttcgccacaacggtcagccctattccggcatgaatgtgctgctgctttggtcggagggcctggcccgtggatattcctcgccgatgtggatgacattcaagcaggcgcttgaactgggatcggccgtgcggaagggcgagaccggctcgaccgtcgtgttcgcgagccgcttcacgaagtcggagaccgaccgcaacggcaacgatgtcgatcgggaaattccctttctgaaggcgtacttcgtcttcaacgttgaccagatcgacggtctgccggaccactattaccatcggccgacaccggtcctcgatccgattgagcggatcgagattgccgatcgcttcttccgcgacactggcgccgtcatccggcatggcggatcgcaggcatattattcgccggtgaccgaccacatccagatgccgccgttcgagaccttccgggatgtggagtcctactacgcgacccttggacatgaggaaattcattgggttggagccaaagatcgtcttgatcgcgatctgtcgcgctacgcgaaggaccggacggagcgcgcccgcgaggaattgattgccgaactcggcagctgctttctctgcgcggacctcgggattgctccagagctggagccgcgaccggatcacgcctcttaccttcagtcgtggctcaccgttctctcaaatgacaagtgggcgatctttcaggcggcagcgcatgcgcagcgtgcagtcagctatcttcacggtctgcagccgtccgcggaaggtgccgacaaggcggcggcataggcgtgctttgaatcagggacggtcgccagtaccgacggccgtctctctgattggctctggttcggtttgcggatgctggttcagggtgaggtccaacgtgccccagatcgatgacttcgtggcatcggacttgggtttgcgagacggcttcctctcgacgatgaacggttttgtctgctgacgcataaatcctcctgggcgacgaatcgcgcctgaacgatatcgcgcacgccaccgaacacaacaggctgtcattccaagtttcataccgacggtttcgacggcatgccgtcgccattcgcgacaaaaggattcccaccctcccccgcctgtccaggttgtttgtaaggaaaacacttcgccacatgggttgttgcggaatgctgcgtcgcacaaatataggatgcgaggatatcaactggaaggggcaggctgtggaaaaatacgtgggcgcgaagctgcatggcattcgagtgaccgacgcaaagctgaactaccacggctcgatcacgatcgatgcggacttctgccgggaggtcggtctgaaaccgctggaatatgtggaaatctggaacaagatgtccggagcaaggatcagcacttacgtgctctacggtgatccgggctccaggtgctgcattcttaacggtgcggccgctcgcacgtgccagcaaggcgatgagattatcatcgcgtccagcgtcttttgcgaaatcgatgacatcatcaagctcaagccacgcgtgctggtcttcggagaaaacaatgaaatcgtcgacaggatcacctacgaggtctttcgccgtgcagacaattctctcgacatggccgtgagctccgagctgcccgacaacagctacggatttccggcctccatttccggatagcctgatgcagtcggacggcgtccctggacgtttgccgatgtggattgccacgacaccgttttcgcctattgccgttgcccttcaggggagccattgtcccgtccctttacctgacgttagcggcgctccatttgcgggctcgatgaggcatgtctgaccggagagcggcgtcgcctcgatcgtcctcccgcaacggccattcgaaactttcttcccctgccgacttcgtcgccattcctcgcgcgacaacaaagttgctcccggccgccctccatttcatttcggccctctgggtgcggtccgatcgtccccggtccttgcgacagccatcgaggccgcaatggagcggcccgaaacagcaaaaggaacttggacaatggctaccatcggcaccttcacctccaccgaaaacggcttctccggctcgatccgcaccctcgccctcaacgtcaaggcccgcatcgcccgcgtcgaaaacccctccgacaaggggccgcacttccgcatctacgccggcaacgtcgagctcggcgccgcctggcagaagacctccgagcagggccgcgactatctctcggtcaagctcgacgacccgagcttccccgccccgatctacgcaacgctggccgaagtcgaaggcgaagatggcctgcagctgatctggtcacgccccaaccgcgactgaggttctcgaggctccgccgatccggcggagcctctcccgccaaagtgagaagccggcaccaggcatcgagccaggttccggctttttggtgccatgcggaaacggggatagccgctcagatttcctgatggtgccgggccgggccgacggcatcaaggacgagcggttaacccccaaatttcaggcccggtcctgcggcccgatccagaaattcggctcccccactcgccgcctccggcggtcgctatcgcgatccctgaccccgccatcccgtcccgccctgcgagctcgtctttcacgaactcaaggagatgagatcatgacgatcgaacagcacatcgaagaactgcgggccgagctgaacaacgcatgcgacgcggccgagcgccgccagatcgagggcgagcttgaacttgcacgggccgagctcgccgtgcaactggccgagcaggtcggcaccatcaaggccgagccgcccttctgaggcggcttctcttctcatttcagagccgagcttcgtcggcgatcaccgtctccgattccagcgctttccgcccgaggaacaaccgcgccatcgcatctctcctttcgacacagctgtcatctacgtcaggggatgttgcagtcctcgcgtcacgccgcaaccttgcgccaccagaattttccccaccgcatgcggctcctcgcccagtcaaaattcaggcggctccaggttctccgctcgcgcttcgaccgttccggtgcggccctcctccgaggtctgctttcgatccccgcgatatcagcaattcgaaaggagaacctaccatgcaacaactcgcaaagttccttgcagccaccggccgccggctcggtaatctcgggagagtgatctgtcacttcttccgcaagggaaagctcgggctgaagctcgcgatcaagattccgttcttcgtcgagatcgagctcaacttcgagaccgactggaataggcgcgaatgacgcgccatggccgccctcggcggcccttttccttcgttccggctcgggcgtcatcgttggtcagctgagaggacgctgggcaaaagtcctcggtcgatagccgcgagctcgcttctgccgcgtcaggtcgaggaacagtctgaccgcttcttcctcccgcccgaaatggtgcaccatcatttgtccagaggtcccgatccgcccccagcgtcgcgtcaggcaggtttccccgaaaagcgatatggaaatctgcatggcgtaaaagcgggccatgttcttcgccgtgtcggttcgctcgatgtagagctggtaaggttgcgtgaccatgttcgcagagtcgccgatccgtgcccgagcgtccaacgacagttttgaatcgttcgaggccaaccgattcattgcggtgatgtttctcaaaacctgagcgattgtctgggcgagtcggcgcagccgcacggctctagtcgctgtggctcccggagcccagtcggtctccgcgcattcgcgtgacgatcctctcgcggatggcacagggccaacctcgcgcgatcagttgcagtatcccgagcgctccggacatggccgtgcaagtcatccgagagtggatccgacgacttcattcaaactttaatttaattttcattctctctgaataattattattgcaatcaggttcaactaggcaaagcacctgcggatcaggcactgcagcgcaatgagagaaagtcagagacatggcagaaattatcgacttccccttggagcgcagcctcagcaccgaacaacgtgcactgatcgaccagatggaagaagaaggcggccgctttctcaaggcgacggagagcctgcttggcgtcctgcggcaagctgaacgtacgcagaaggcaattctcgcctaccaagccgagatcaaaggccggagcggaggaacggcgcaggtagccagtcgcgaagcgggcgacggttccgcagctggcgactatcgcggcagcactatccgatatgcatccgatgactgaagtttttcgagtgggtgacgatcgtcgccatcgtggccatacgtgaggggacagaccgtgcttgggttcgcaaaacaaaaacaatatgctctcctcttgggagcagcactcctccttggccacagcgcaagagcgcaagacatagacttgatgaacggggtggtagcccgccctggtgacaaggacacaatacccgcagaaaaattcaagaaggcgagcccctggaaaatcgggatgagccactttggcgtcaacgccaacacatgggctgcccaaatggccgctgaatcgcaagccgctgccaagagtgatccgcgcatttctcagttcgtgctgctcgacgccaatctcagccaggccaagcagatcgccgatatcgatgagctgatcgcccagaaggtcgatgccatcatcgtgacaccggtctctccgacctccgcagatgctggtatcgaaaaagcggtcaatgccggcattcccgtcatcgtccatacgggccttaccaaaaccgacaaattcaccgtcgatattcaaggcggcggcgagaacttcggaaaggtctcgggagagttcctggtcaaggaactcggaggcaagggcaatatctgggtcctgcgcggactgccgactcatcccgaagacatcaaccgctacaagggcctgctcgaagccatcaagggcaccgatatcaagatcgtggccgaagatgccggtctctggtcgtatgattacggccacaaggtttgcgagaccttctatctcgaaaacccgaaggtcgacggcatctggtcatcgggcgccgacatgagccgcgcctgcatggatgtcttccagcaatatggcgcgaaggttccgccgatcaccggtgaggtgaacaacggatttctccagaaatggatcgacagcggggttgatgccatcgccaccgaatacgggccggaacaaggggccgcagctgttcgcgctgccgtcgcgctgctcgatggcaaagccattcacaaacgctatgtctatgagcccgacggctgggacatccagaaggcaaaggcgaattaccgcgctgacctgtcggagaagttctggatgccaagcagcctgaccgacaccgatcttaaggccctgtacggcaagtaagacaaatgcctgccccgcgttaccgcggctcgatgaacgtcagaagtcgatgtcatcacgaaactattcgaaccaccccagcgagcgtggcgtgatcaaagcgcccactgtcgccccgaatccaaggagccgtcttcgatgacaccagcaacagcgaaatccaacgaccgacgtaatttcgggatcgccggacgcttgacggcggcatttgtcggcattgctgccctcgccgccatcgccggcgcctcctcgtcctggtattcgatgaaaagttccggcatcgtcaaggaactcggcgatcgaaccctcccaaccgtcaccgaatccctcgccttcgcgcaagaaagcgccatccttctcgcagaggcgcccaatctcgtctatgagccggatctcgcttcgctcgacgcaagttcgaagcgcctggaagccatcctcgccggtcaaagcggtcgactgacggctttgcgcgaccttggcgtggcgccggaactgctcgattcggtcgagaagacgagccaaagcctcgaaccaaagctcaatcagctgacagccatatcttccgaccggatcaaggcgaaattccgcatgcaggagggcgtggctcgcgctctgtcccgttacaagtccctggcgtcaatgctccgcaacgcgcaggtcggagcggtggacagcagtatcgagcgatcgcgtgccctgaccgatctccagatggcggccgccgagatatcgacactgatatcggcgataccggatgcgtcagacaccgaactggccgcagtcaaggatcaatatgatgcgactggcaaggagattgacagcatcctcgcgcggctgaaagcttcaggcggtagtgctgcgatgcaacagcttgtcacggctctccagaatgagggtggaggtcctgaaggcctgtttgcgcttcgatccgcccaggccaaggtcaacggtcagatcgcagatatgctgaatgatctgacggtgacctccatcatccttggcgtcgacgtcaaattgatcgcggcgaaggaaaagcaggccgcccgaaatgctgcggaattgtctcgggggatgacccagcagactgtcgccgtcaatgcggcaacgagctttctggtgattgcagccgcgcttgccgccctgttctacgtccggcgtttcgtgacgcggcggctgatcaggcttgcgacggtcatgggccgtatcgcctccggtgatcattccactcaggttcccatgtccggtcgcgacgagataacggacatggccggcgctgtcgaagtgttccgcgccaatgcggtcgccaatattcgcctcgagcaggaagcggaagaacagcgaaacctgacggaagacgatcgtcgccgtaaggctgaaagcgatcgcctccgggcagaagccatggcccaagccacccaaggtctcggcaaagggctcaagcacctttctgcgggtgatttgacgttccgtctctccgagcccttcgcggatgaattcgagacgctgcgcgccgatttcaatggcgcggccggccagcttgccgagacgctgcgctccgtcgccgacgcggccaacgccatcgatagcggcagccgcgaggttagcatcagcgccgatgatctctccaagcgcaccgagcagcaggccgcgtcgctggaagaaacggcggcggcgctcgaccagatcaccgtgaatgtcgccaattcttccaagcgggccgacgaagcccgcaggatcgccgcccaggccaataccagtgcctcccaatccggccaagtggtggcgagtgctgtcgacgccatggagaagatcgagcaatcgtcgaagcaggtctccaacatcatcggcgtcatcgacgaaatcgcgttccagaccaatctacttgcgctcaatgccggcgtcgaagcggcccgtgccggcgaggccggcaaaggcttcgcggttgttgcacaggaagtgcgtgaactcgcgcaacgctccgccaaggccgccagagagatcaaggagctgatccgcaactcctccgtcgaggtggagaatggcgtgaagctcgtcagcgagaccgggactgccctgaaaaccatcgagggctacatcgtcaccgtcaaccagcatatggactcgatcgcgacatcggcccgggaacaatcggtcggtctcgcggaggtgaataccgccgtcaaccagatggatcaggtcacgcagcagaatgcggccatggtcgaggagagcaatgcggcgagcgcgacccttgccggtgaagcaggacggcttcgcgacctgatcagccagttccagtttggcgaagccatgcgccggccggcgtccctcaccgaggcgagcccatccagccggccggtcgcatcgcccgcgcgccggatcgtcggcgccgtcgccaaggccttttccggcaacgccgccgtcaagcagacctgggaagagttctgagcggagctgaaggtgcactgactgaaggtcttttggccatcagagctggcaagcggtcgcgtccttttcaggacgcggtcctatctctctctgacgtcctatcttgcacccgccgttccggcgtcaatgacatcgcggcccctccaattttccccgcaccgcaagcggcacagagaaagtcggttcctccgctcgccgcacggcggccgcgttcagcggtccctgacccctcacggacttcggtgcggacacttttcgccagaaaacgaaaaggagaccctgatgacacagcatcacatcacacagccggttagcgaagagcggaaacttgcggatcagcagccgaccgggcttgaacatctgcgcagcagtttcgatgctgaagtgcaccttcccgccgatatctcgcgcgagtttctgtctgcggcgctgctttgggccatcgacaacaaggtcgatttcggtttgttccacgagcccggaaagatcatcatcgcgcacttcggtggtgatgagatctacctcccctcccggtggtccgacaaacgatggcacatcggccttgaggacaaggagcctttcgacccgggcgattgaagcccagaccagaggcggcttaccgcctctggtctttgcctttcgcttgagccgttcctgccggatcgaccagccgagccggctatgatcccaagccccatctctctctcctgacagcggacgatgatgatggttgtcatttcccctggcaccagccatgtcgcgcgccatcccatggccgggcaaggccttccttgatcaaaacatcgcccagagaattgcccgcacgcgatacggttcgaagtttacgtccatacttgtcctcgtcgcggaagccggccgacagcgaaaactttccggcgttgagcagcgttagtagtcgcgactttgccgcttcacctttgatccgttcagcttcgcagcggggcgggctgagttcgggcgtatcgatgtcggcgatgcggattttcttgccctcgaaccagaaggtgtcgccgtcgacgacgcagttcgtgcgatggctgtcgccgcagatcacgaacgacgccgattggctgtcttgcgcaggcgctttgacgaaagccgcagcgatgtcgagatggccattgcgatcaagatagagccagcccgcggcgccgatcaccacggcccagacaatcgcggtcggaaagcctcggccgcgatcgtgaccatgacgacgcggcgtcgatcgcgagtcattaatgccgggacggtcgttggcgaccttccgatttttcctgaacgggatgacgttcttttgcgccaagcttttcattcctcttcggcggcagaggttacagccggtttggtttcataggcgtttaccgcagacgccgaattcgaaccttccttctcccttccgcccatcgaatgaaaccggttctcgccgacgcaggctctcatatcgttgcgccggaaccagatggcgcgcccgcatctgagcggtgcattgccggccgtgaacacgatctgctcgtcggcccgcatgcgcagaacctcatgcggctggataagcggtctggcggcaagctgcttcgagcgtgttcgcgatgatccccttgcctgggaactgcggctgacctggtcgatctcgaccgtggtcatgccgcaacgtttcgagatgtagtcggcggtctcgggatcgttaattgcggcgaacgagatccagctggcactctcgaaccacttgcttgccgcgtcgcggccgccataggtttcgcgcatctggccgatcgactgatagatcatcgtcagcgtgattccgtatttgcggccggcgtcgcgcgcagtctcgaggatccgcatgtaaccgaggcgggcgacctcatcgagaagaaacagcgcgcgcccttcaagctttccgtcgcgattatagatcgcgttgagaagcgagccgatgacgacacgcgcaagaccggaatgagtctccaacgtcttgaggtcgatgttgatgaagacgtcggtatttcccgcggcgatgtcgctggtcgagaatttccgtccggacaccagggcggcataattcggataggaaagccaatgcgtttccttgaccgcattggcatagacgccggagaaggtttccggcgtcatattgacgaaggcagcgacgttctccttcacgaaatccgaacccgaattgtcgtagatgtcctgcaggcgcttgcgcaaggtcggttccggctccgacaggttcatgcgcacccggcgaagcgtctggtccttctcgtccatgtgaccggacaggcagacatcggcgatgagcgcggtgagcaactgcagggctgacgcgcgaaagaagtcgtcacggacaccgcgcgcgccgccgctgtcgctcatgatccacgatgcgacagaggcaatatcctcttccttcgttccgccgaaacggccgacccagtccagcacgttgaagcccatgtccgacttcctcgggtcgaggacgaacacgtcccttcccgctccgccgcgatgcgcggagaccatcggggcgacctcgttcgacggatcgagcacgatcagcgtgccgccccatttgagtgccgtcgggatggtcaccgacgtcgtcttgaaaccaccggaccccgcaaagacgatcccgtgcgacgagccgaatgagccatcgaagcacagcaacggcgacttgccgccggcgccccaggtctccgcgctatcggctcgaaatgccaatgccgcgacgctgtccttgtcgacccgatagcgctcgccgatgacgatgccgccggaatcggaaaacagcttcgccgcctctggcggcttcatccagtcggcttcgccatgcagtgccctcttgccctgaatgcgctttggctcggcccttgcgaatgccgcattgccgatgaacgcaacgcggagtgcgaagcaggcacacatgaacgctgcgcctactccaatcgacgttgccggatcgagataggcgaagaccgtcttgccggttggcagcgtcttcgtgaaagcggcaaggcgtatggtttcgcgggtagccgcgatcaggatcgttccactgcatcccgcaacgacgccccagcctgcctgcttgatgctgatcgcgccggcacttgcgaacaagaacacgataccgatcgccgcgctggcgacatagggcagcgcgatgcccgcacgcccccatgccaagcgtgcggcctcggtcttcccgaagccggaaatccactgctcgatccccgtcatcccgatgacgaccaggatcatcagcgccgccggcccgacgacgagcgcaatcctattgatcgtcattgccaaaggcctccgcgccgattgccgtgagcctggatcgctcgccctcatcacccttgattcggcgggcgacatcgatcagcgcgcccagcaacagcgcgcgcttctcgtaacgcagcccggccttgacgatcaggccgccgagctcgatcttttcccgcgtttccttcttgcgggcgtcggatgtcatcgtcctcgccatacgctcaagcctcgccagtgctgcccgcgcccgcaccagaggagtccgccggcgtcgacgttgcgccgctgctatcgccggcaccctttttccctccgttcgtagcgcccttccctcccccttggcctccgcgaaaccgcgtcgccacttcctcgaaagcggcctgcagctccccttcctcaatctcgatctcgccaaggccggccttgagcgcgatccggccgatccgctcggcttctcttgtctcggcgaccttgagctgctcctgcaacttggcgatttcgtcgcggattttcgaggcaggttttttcatgtccgatcgtctccatggctgagaaagcttgtctttcgaagccagtctttccgaacggagtgcggaacgcactactgtgaatcctacaatcgccaagggcgattctttggtgaatgatcccggccgttccgaaggagcggcttccaagggcgcaattatacgtcgctcacgcgacgcccttgcttggtccggcctcccgctcccgacgaacccgttgatttcgtttgcaaccgggaaagaactccgccgtggccgtcccccatttctccgtcagcgtcgtcgcccgcggctccggccgcagcgctgtcctgtcggcggcctaccggcactgcgcgaaaatggaatacgagcgggaagcgcgaacgatcgattacacccgcaagctggggctgttgcacgaagagtttgtgattccggcagactcgcccgaatgggtgcgcagcatgattgcagatcgctcagtcgcgggagcatccgaagccttctggaacaaggtggaggcattcgagaagcgatccgatgcgcagctcgccaaggatgtcaccattgccctgccgctcgagctgacatccgagcagaatatcgctctcatgcgcgactttgtggagaggcacatcacggcgaaggggatggtcgccgactgggtctatcacgacgcccccggcaatccgcatgtccacctgatgacgacattgcggccgctcaccgaagatgggttcggttcgaagaaggtcgctgtgctcggtcgggacggcaaaccgatccgcaatgatgcaggcaagatcgtctatgacctgtgggccggtagcactgaggacttcaacgctttccgcgacggctggtttgcctgccagaacaaacatctggcgctcgccggcctcgatattcgcatcgatggccgctccttcgaaaagcagggtatcgacctcgagccgaccattcacctcggcgtcggcgccaaagccatcgagcgcaaggccgagcaatccgacgggaagcaggagaccgcgcctcccaaactcgaacgcatcgagcttcaggaagctcgtcgtagcgagaatgcacgccgcatccagcgccgccccgagatcgtgcttgagctgatcacgcgggagaagagcgtcttcgacgaacgtgatgttgcgaaggtgttgtatcgctatatcgacgatgcccgtctcttccaaagcctgatggtgaggattctgcagagcccggaagcgctcaggctcgagcgcgagcgaatgaatcttgcgaccggggtccgagagctggcgaaatacacgacccgggagatgatccggcttgaagccgagatggccaaccgcgctatctggctttccgctcgcgcctcccatggtgtccgtgaggcggtgctgcaggcgacctttgcacgccattctcgtctatcggatgagcagcggacggcgatcgaacatgtcgccggcggagagaggatcgccgccgtgattggtcgtgccggcgccggcaagacgacgatgatgaaggctgcccgtgaggcgtgggaagcagccggctatcgtgtggtcggcatagcactggccggcaaagcagccgagggattggagaaggaagcgggcatcccatcgcgcacgctgtcgtcgtgggagcttcgctggaaccagggtcgcaaccagctcgacaacaagactgtcatcgtactcgacgaggccggcatggtgtcgtcacggcagatggcgctgttggtcgagacggtgaccaaggccggcgccaaacttgtcctcgtcggcgatcccgaacaactccagccgatcgaagcgggtgccgcctttcgcgccattgccgctcgcatcggctatgccgaactcgaaacgatctaccgtcagcgccagcaatggatgcgcgatgcctcgctcgatctcgctcgtggcaatatccgcaaggctgtcgacgcctataccgctcatggtcgaatgattggcttgagactgaaggacgaggcggtcgagagcctgatcgcagcgtgggaccgcgactacgacccctcgaagaccagcctgatcctcgcgcaccttcgccgtgatgtgcgaatgctcaacgatatggcgcgcgccaagttggtcgaacgcggtgtcgtcgcagaaggatttgcattcaagacggaggacggacaccgcaaatttgcgccgggagatcagatcgtgttcctcaagaacgagggcagcctcggcgttaagaacggcatgctcgcaaaggtgctcaaagccgctcctggccgggtcgtcgccgaggttggtgaaggagagcaccgccgtcaggttactatcgagcagcgcttctacaacaatctcgatcacggttatgccacgacgatccacaagagccagggggcgaccgtcgaccgggtgaaggtgcttgcgtcactgtcgctcgaccggcatctgacctacgtcgcgatgacccgccatcgtgaagatctcgccgtctactacggcagtcgctccttcgcgaaatccggcggcctcatcccgatcctatcgcgccgaaacgccaaggagacgaccctcgattacgagcaggcgtcgttctatcgccaggcgctgcgcttcgcggaagcccggggcctgcacctcatgaatgtcgcccgggcggtcgcgcgcgatcgcctggaatggaccattcggcagaaacagaagctggtcggcctcggcgcccgtcttgccgcaattgcaacgaaactcggtttcgtcggcaacttcaaaaactccccaatccagaacccgatcaaggaggccaagcccatggtgtcaggcatcaccaccttccctaaatcgttcgagcaggctgtcgaggacaagctcgccgccgaccccggcctcaagaaacaatgggaggacgtctcgacccgcttccacctcgtctacgcgcagccggaggctgccttcaaggcaatcaatgtcgacgcgatggtcaaggaccaatcggtcgcgaagtccactctcgcgaaggtcgccgacgcccccgaaagtttcggtacgctaaagggcaagcccggtcttcttgccagccgtgccgagaagcaggaccgggaaaaagccatcgccaatgtcccggcacttggccgcaatcttgaacgctatcttcgtgagcgggccgaggccgaattgaagcatgagacggaggagcgcgcggtccggctcaaggtttcggtcgacatccctgcgctctcgccagcggccaagcagatgctcgaacgcgtccgcgatgccatcgatcgcaacgatctccctgccggccttgaatatgcgttggccgacaaaatggtgaaagctgaactcgaaggtttcgcgaaggctgtgtccgagcgtttcggagaacggaccttcctgcctctcgccgcgaaagacaccaacggcaaggccttcgagaccgttacagcgggcatgacggctggccagaaggctgaggtccagtctgcgtggaattccatgcggacggtccagcagcttgccgctcatgaacgaacgacggaggcgcttaagcaggctgagacactgcgccagacgaagagccaagggctctccctgaaatgacggcggcagctagagcgcgccaggcgataaccgcgcaacaacgacgagcggccgtgatcctctcggccacgacgttggccgctatcgtgctggtggcgactgccctcgccggcggttatcgcatcaatctgaccccgagcgagccactcggcctgtggcgtatcgttccgctcggtcgccccgttgctgtcagtgacctagtgttcgtttgcccaccggcaaccgcggaaatgcgggaggcgcgagcgcgcgactatctccgttccggttcctgcccgggtggcgtcgccccgttgatcaagacggtgatcgccgtcgcaggccagcatgtcgaaatcggcgccagcgtgattgtcgatgggcgggtggttgcctcttccagcctcgcgccacgagacggaaaggggcggccgctggcgccgtttccgagtggcatcgttccgccaggacatctcttcctgcattcggcgttcccgggctccttcgactcccggtacttcggtccggtgcccgcttcaggcattctcggcctagcgcaggagatcctcacctatgcgccgtgagtttcttcgggcgacgcagctgatagtcgcttcgatcgcgatcggcgtggtgggctggagcggccacgcgttgcttctgcccgtcgccctggcgtttcccgttctttggtcgatggcgcaaacgagggcggtcgcggcccttgtctcggccagctattttctggccgcatctcgtggcctgccgcaaggcgtcgctgccttctattcgtctgatatctggccggggctgctcctctggctgtgcgcgtcctcgagcttcgtcgccgtgcatacggtcctgtggaccgggatcgccggcattcgtccgttccgctatctccttgcggccgtcatcatggccgtcccgccgttcggcatcacgggctgggcgcatcctgtcacggccgctggagttttgtttccgggatggggatggtggggactgggctggatgacagctggccttgcgggcctcgtaacccgcatatggccagctgtcgccatcgccttgaccggcttttggctatggtccgccgcaatctggaccgacccgagactaccggaagcctggcgcggcgtcgatctggaaatgggcgcttcgcttggccgcgacaccggtcttcgacgccagcatgacctgatcgcaacggtgcgcgacgctgccggcgatggcacccgctttgtggtgttgccagaaagtgcgctcggcttctggacgccgaccgtggagcgtctatggacgggcgcacttgccgatggcgatgccaccgtcatcgccggcgccgtggtagtcgacgcagacggctacgacaatgtcctcgtctcgatcgacggcaagggtcgccgcatcctttatcgcgaacgcatgccggttcccggctcgatgtggcagccatggcgatcctggtttggggagagcggcggcgcccgggcggatttcttcgcgaacccaatcgtcactatcggtgccggccgggccgcaccactgatctgctacgagcaactgatcgtttggccggtcctgcagtcgatgctgcacgatccggacgccatcctcgccgtcggaaacggctggtggaccgaaggcacgtcgatcattgccatacagcgcgccgcgactaccgcctgggtaaaactcttcgcaaagccgctcgtcattgcctttaacacctgaaaggagacactatgctggacgccgccctgatcaaagaatgcgccgacccttccctaaaacccgcgatcgtcgaacggttcgtggtatcagcaggctcggctgatcccctcgccgtcaccgtcaaatccggtggccgtttgatcctcgtgccaaaagctgcgtcggctgacgaggcgatggtgatcgtgcggcaatatgctggtcaggcggtggtccgcgtcggtctcacgcagtttcccgccggcgttggcgtcaaggaagcgagtgatctcaaaccggacctcgtcgatgcctgccagaacctccgcaaaggcacggcgatgttcgccaaggtgctccggatcgtcgcgaaatggtatggcaacccgacgagcaaagatgtcttcccgcagatcttcgaggatgcggtctacgcatggaagaccggcgagttcgagggcgtcagtgtgtttcaggcggaggatccgggaacggcagttgaagtgccgcagcaaagcgaggagaagatccccgacgaggaagagagcgccgaaccgaaaccaggagagcaagagcctgagacggtgcaggatgttggccgagcggggatgcggatcgacctctcacacattggaggccaaaaatagattgacttcgtttcgccgggggcagcgaggcgagtattgaggttcaaagcagaaaattagtgtaactcaaatgcatgatattagtgtttgtcggaacgccccgcacgaacgtggtgttcgagttgatcaaagcaccagcacagccatccacgaaagaacggccgcgcggaaatacgattagagcagattcatgcccggctgcgtcataacggggcctcaagggcagcaactagcagtcagcacgcgcgcgtctactcatctcgtcacaagcacggcaggttcgacgcccagtgcctctgcgatttggccaaggacggtgacggtcgccgacatctcggcacgctcgattgctccgacatggcggacactgaggcccgtacggtgggccacttcctcctgcgtcaattgtttgccatgacggattcgacgcatattgatcgccatgacctccttgagatccatgacgcgagcggaacctgaatcggaactattattccaggaactatagttccgattcgtcacggcgcgtgatattgctcgtccaggccgtcacaagttaccttgggatatagggtatatgaacttctgaaagacaggccgtgcagttatggcctatgcggtataatgctcaccaggatttggctttcgagcggcaaatgaagaaattaaggggaagcggatgaaggacgtgaacttatccgagacaaaacacgaaaccaaaccgatgggatcctgtttacgttcaatggaaaaatcagaactagaggcgcttgctatatctgcaatccgagagcaccgccggcttatagtcgccgacgaagctgtttatgaggaatggacccgcgcgtccgccgacccctcggtttcgagcgccgtgctcgaaagcttgcagcaagagtatgccgcgcggcaaaggaaatccgaagcccagcaggaagagctttcggagatcatcgatgtgctcggctacatccccgaggttccgctcgatggcgatgaatgacccctcaaaccaagccgtgatctttagcgatcgcgactagatgtggaacggtcgccgcgtcaagtttctcgcgcgctttatcgaggtagtgctgcaccgtcctcgcgttgatccccgtcaacattgcggtttccggggcacttttgccctttgctgcccacatgaggcacatcgcttcccttggcgagagtagccgcttcggagcgattatcgtcgtcgaagcgataatcttcaggcggtaatggattgcaaggaccgtccggacggctttctgggcgtccagcagtttggctttctcgactttcttctccgacgaggcaaaggtcagcatcatcgtcgacccgaaactcccttcgaccggaatcgtcagcccactgcgaatgccgtgctcgatcgcctggtcgcgaaaccgtctcagctccgaggtgccacgagccggccaatcatcggccgtccagtagaacatctccatgcgacgcttggcttccgtgatgacggggtcgatgcgcgaatattggccgccaagatagatatcctgccatccctccggataggagttgaatgtgcggatttccaggccctcggtctgaagatacgcaaaacgttcgaagccatgggagtttacgaagcttttcagggcgcccttgatcatgcgttcatcgtgcgcagcttccgtcatatcgattaaagagcgaaggtctccgtccacggacttgtctcctcttgcgcagctgcgagcctcccacccgtcgcgcctaccacgcgccgcgagttacctggtgccaccgttcggccagccggagccatacggaacatcggaccgtggctgcgaattccgtgtccccattcgtttccgatgaaaacgcagttgccttctgccgaagcatatccacggccgttgcaactggttttctactcacctctaccgagtattcaaggcctcttcatctaaaatatgacaatttgagagaagattttggcgagcgctgatttctgagcgcggatggatcgctccacccgacgaaacgacgggcggagcagcgttcgagatgggttagcgcccgctataaatggatggaaagatgatatcctggtccgcgagaacgttgaacttatagccaggacggatgcgaatcgtcggctgaacgttgaggttcttcgagattgtctgttctgtgacgcgaccgaagctttcggcaaaattccgccgtgctgcatccgatgccgtgtcctgggtggccaatgttgaactctccggcatcgacatgtcgatccccgtcccgatgattgccaccagagctgcggaaccgaacgtcctccagagatggcggtcaaccttgtcctggaagccgccatacccctcggcgtccgtgccggccatgccgccgatctgcagggtggatccattgggaaaaataaggtcagtccagacgacgagaacacgctcctggccgaatgagaccttggaatcatagcgaccgaacagctttgcgccctgcgggataaggaggcgatagccgctcgcgctgtcgtagacattctggctgacctgcgcggtaatccgccctggcaggtcggaattgaggccggtgatcaaggtggcgggaatgaccgagccgcgcttcagttcgtagggtgacatctgcggcacgacctggtttggcaggtagccgagatccttgatgtcctgattgaaaaaatcctccttcgacggctgtccgttctgatcgacgttttggcccatcaggccggatttcatggcggcggcataaaggtccgacgcactgttgacggctgcatttgtcggctggcggccgctgtcattggtggaggttgccttctcgaagtctccgatgtctaccttcagcggcgaatcgagcgccgtagcgcgagcctggaggcgagccatccgctggcgctgcgcttcccggatatactgctcgtcctgctcccgcttcaggcgagccttccactcctcctcggattcgagcgagcgtctctcctgtcggtcattcggccggcgttcaacggcggtctcctgtttctcgaccttctgctcgacgacaggggtcggttgaaacacttcctgcttctccggctcgccgatgatgccgtcggtgacaccccgtttgagctggtcgccgaagctggtcgccggggtgttggaagccccctcgatgtcgcctcgatggaaggacagcccccgcagcgacaggccgatcacgacgacgccaacgaagagcgcgacgacgatgatggcgatgatgatcggcaggcggttgagccggcgcatgccattctgatcgtcggactgggctggcgcgccaagttggagcgactggaccatattgctctccgtcagttgcgctgcatgatcgaaagtggactggtcggcgtggcgccggccgccgtcggcgtataggcgcggccaagagcgatggaaggcgtcgaaacgcgcgcaaaaacctgcccgtcgaagccctcgacggcaaaagcaagctcgaccggcttgatgtctttggcgaccttgccgtccgtgacgaccgtataaccccagcccttcagggccgcctcgagggcggtcgcgaattccgactggtccttttccattttgatggtcgtcgcagcgctggccggaccgatttgttcggcgagacgacttgccatgtcaccggcgatcgcgcttgcggccggtccggtgacggcaaccggggttgcattggtggtcatcgcgtcgtcggccgtttggcaaccggagagtagtttggccgcgatgaagagtgcgaggagcttgcgcatggttcagcctccccgccggatggtgatcttctgctgccgccacccgacccctgatacgaggatcgccttgtcgatcgcatagtcgacggtcatcatgttgttcttcatccggtagttgacgatgcggttctgaccgccggagacgacgaagagcaccggcgcatcctgacctgagatcgacttcgggaattggatgtaggtcttgaccccgtccgaatagacccgcttcggtttccacgaagccccgccgctgatcgaataggagaagttcagcttatccggcgccgtgcccggaatgccgccggtttcgagacgggcattgatgtcggcgagcttggtggaggtgtcctcggggtactcgaaaccaacgcgcgccatgtactggctgggatgggacttgagctggatatgataggttcgccgtgaggtggtgacgaccatcgaggtgagaagacctggctccgacggtttgacaatcagatggatggcctgcccgcctgtcgcccccgaggtggccggctccactttccaccgcaccgtatcgccgacgagcacgtcgcgaacgatctcaccgccctgaagctcgatgtcgcagacctgcagcggcgagcagacgacggacggctgggtctcgccgaacagaaaaatcactttgccgtccggtcccgttgtgaccaggcccggtgtgccgcgccatttgcgggagatattcgtacccttgacctcgttgctcgtcatgctttgcgcctgcgcgcccaccacaaaggcgagtccggccatgcagccggcggctgcgatcaatcctgtcttttgcattgagaaatccctgcccttaaagctgtgccgtccagtcgaaatcccggacatagaggccgatcggattgaggcggatcgtcgcctcatcctgtggcgcggtgagcgccaccgttgcgatgccgcggaagcggcgtgtgccggtttccttgcccttgcggtctcgctcgtattccgtccagtcgatctgataggtctggttcgagagcgccacgatgttgttgacctcgatggcgacggtcgaggacttcgctttctcgaaaggtgaattgcctcggaaccaggcgttgaccttctccgtcgacggatcggaggtgcgaagaagagcgtatgtgcggtcgatatattgcttctgcaccacggcatccggcgtgatcgagcgaaagcttgtcacgaagttgccgagtgtggcgcgaaccacgcggacatcggcatattcgatctgctccgggaagcctgccgtgactgccgtccccagcttgtcgacctcaacgatataaggcacgagcttgacctgggtactgagatacatcgcgtagctgaagccgatgacggccatcgtcaggccgagaatgccgacgatccgccatgcggaagcagccttcacatatgtgccgtagcgctcgttccattcctggcgggcggcaagatacggattatcaggggcgcggttcgctgccatttattcttcccttgtctcgattatggtttgtcgttgcgttcgggaggaggcgtcgggccgctgtgaccgctgcgctgttcatcgagcttggcgttggctagtccgaggatggaccccgcataagcaccgggagatccgattgccttttccttcgcggccgagcctgcggcttgtgccccggaactgaagcttgcgcctatcccccgcagggcagcaccagcgacggatgaaccgccagctcgtgcggcttgggccgccgcaaaacccgcgccggcagcgccggcggccaagaatccagcgcccgcggcgaaggacgccgcttgcccgccgtggcggattgtctccataccgccggtgacggaggctccctggacgacaccctggatgatgttcggcacgtacatggcgatgatgaagaccacgacggaaataccggcgatcgccagggtggtgacaaactggtcggaggatgcggtcggggcattggccagacccaagaggacctgtgacccaatctttgcgatcatcaccagcgccatcagtttcatgccaacgccgaaggcgtagacaagatagcgaacagcaaagtctttggtgaaggaggaaccgcccaggccaagcatgatcatgccggcgagcaggccgacatacatctcaaccatcaccgaaacaaaaatcgcggcaaccagcgaaaagcagatgacgacgacacccattgccagcaccgcggcaatcgccagcgcattgtcctcgaatacgccgaactgcgcctgttgcgacatttgcgaggcgacgcgaatgccggcatcgaacacttcagcgggcgaggctgaaccgccgccggcaccaatttggaaaagactgtcaaccaccgcccgggcaaaggtcggaccttgggtcagaacgaatgcgaagaacccgacgaacatgatccggcgcaccagctccgcaaaccagctatccagcgaggctgactggatcgccagccagacggcggcaatgccgatctcgatcgttgcgaggatccagaacagcgatttcgccgcatccatgatggtggtctcccagcccttcgcggcagaggagacctggttttccagttccgtgaggacctgcccctcctgcgcaaatgcgggagcagcataggcgaggaagaacagaccagttatcaggagtgaacgtgtgacagcgggcttcaccatctcggccgtatctcctgaccatccttgatcggcggcagctccttattcgagccgaagaacttctcccgggctgagcgctgctcctcggtaagcgcaggtcttccgccgtcgctggattttacgatcagcactgtggccgcggcggatgcagcggcgacagcaagcaccaaagcaattaggacggatcggctcaccagcgtggctccattctctgaccttccggaatgctcttgacctcagcgttgaagaacttttcccgccgggcctgcgccaggtccttgtcggtctgctccgtctgtagccaggttcccatcatcgtcatctgttgcgagacgagaccgcgaagcttctgcatctgggcaacctgctgagcggcgatctcgtggccgacctgcaacgctttcatctgcccgtccgccgtttcggacatcgaccgcagcgaggacatcgtatcttcctcgctatcgaactggtcggccgttaggctcgcagccttcagcgagctggcgatcgtgtcgcggttggtcgtcgaccaggactgataagtcgaggagaacgtcgcgttatccggcaggttggttttgaggtcggcgtagctctgaaagcgctgctgaagaacgtcgtcggcgttgcccatggagaatgagatactctgaccctggtcgacaatactgcggagctgattgagatcgctttcgacctgcccccagacatggtcaggcagctgcgcggtgttttgcagcatgttttggtagatcttaagctggttctggatctgctccgcaagctggctgatctgcgtcagctgattgtcgacctggaggcccgagctcttgagaaggtccaccaattgcgcattgttggcgagctgcgtccactccgtcgcagcaccggtggcggtccccgcccgtgctgaaggtacggctccgatcgtcagggccgcggccgccaggcaggctaaccatctattcgaacttgagtagcgatgcggcatcgtgaactcctctcgtttcaagccagcggattggccactcgcggccatgtccggatttcagtgcgcggatgcgcttgaggtcgtccttgcccgacgcgccgacaaagctcagcgcaaccggccccagcgacatgtcgaagagccgccggccttccggcgtggcgacgtagtattcgcgtttggggactgcgttcgagacgatctcaatctggcgctcgttgaaaccgatacgctcgtaaaattcacgtgttcctggctctctggcggcgccattcggaaggcaaatcttggttgggcaagactccttcagcacatcgataatcccggaccgttcggcatccgagatcgattgggtcgcaaggacaacggcgcagttcgccttgcgcaagaccttgagccattccctgatcttgctgcggaaaactgggtggccaagcatcagccacgcctcatcgagcacgatcaggctcggcgatccatccagacgcttctcaatccgccggaacaagtaggtcagcaccggcacgagattgcgctcgcccatgttcatcagctgctcgatttcgaaggtctggaaggccccgagtgtcaggccgtcctcctccgcatcgaggagctggcccatcggcccgtcaacggtgtagtgatgcagcgcatccttgatctcgcgcagctgcacgccgctgacgaaatccgagagtgagcgaccggatgcgctcgccatcagtccgacctgccgagaaatggcgttacgatgatcgggggtgattgtgacgccctgcagaccgaccagcatctcgatccactcggtcgcccaggcccggttggcatcactttcgagatcagaaagcgggcagaaggccaaggccctcccctcttccgcattgtcgccgccgatctcatagtgatcaccaccggcagcgagcgtcaggggaagaagtgaactgcctttgtcaaaggcgaagatctgcgcattttcgtaccggcgaaactgtgcggcgatcagagcaagcagcgtcgacttaccagaacctgtcggaccgaagatcaacgtgtggccgacatcatcgacatgcaggttcagacggaacgctgtcgagccggtcgcaacctgcatcaagggaggggaattcggtgggtaaaaggggcatggcgcgatcgggtttccggcccagaccgaattcagcggaatcaagtcggcgagattgctggtgttgatcagtggctcacggatgttgcagtaccagttgcccggcaggctgccgagataggcatcggtggcgttcagcgtttcgatccgcgccccaaacccttccgcctggatcagccgccggatcgcttcggccttctcctgcagggcttcgcgatcgttgtcgaatagcacgacgaccggtgtgtaatatccataggcaaccagctgcgatgaggcctgcgcgatggcgtcctcggtctcggcgaccatggtcatcgcgtcttggtcgacggatcgactttgtgtctgaaatatctggtcgaagaacggccggaccttctgctgccatttcctgcgtgtgcgttcgagcttctgtcgggcctcctcggcatcaaggaagatgaaacgtgatgaccaccgataggtgagcggcatcaggtcaagactattcagaatgcccggccagctttcagccggcagaccgtcgatcgcgacgacgccgagaaagcgattttcgaccttcggcgtcagtccgtgttcaagctccgccgtggcgatccagtcgagatacatcggaacatcgggaagcctgattggatggttctcgccggtaatgcagaagcgggcgaactgaagcagttcgtcatatcgggcaattcgctcccctccccttccgaccgtttctcgggtttccattcgccggatcgaaagtgtgttggcaaaatactgctcaagctctcgcaccgcgttcttgaacacgaagagcaccgtgtccgcgtaggatttcttccggctctcctcgtccgaatagatgtacttgctgagagctgttttcttggactcgagcggccggtaagtcaggatcagcgcatgcttgctctcgaaatgcccctgctcgcgcgcgaaatgcgcccggcgctccccgtcgattgcgcgggttaccggatcggggaaatggcaacggtcttctgtgggatagtcgaccgtcggaatgcgaatggcgtcgacctggatcatccagccgcttccaagccgcgacagaacggcgttgatctgcctcgacaggtcgttgcgttcgaggtcagtcgcactttcggaatctggtcccgcgaaataccagccggccatcaggcttccgtccttcaagaggaggacaccattgtcgaccaggccggcatagggaacgagatcagcaaaggaagggccggtcgcccggaagcgtttgagagctaccatggccgcctcctcaataccggcgccaaggcgatgtcgtcgccttgtaggtgggcttgtaggaaatgtgcctgatatagacttgccgcatgaacgggtcggacttcgccatcattctgaggagcccgacgatcacgacccagacggcgattccgaagagcgccgaataaaccgtcagcaccacgaagatcaggatgacggcggcgagaccggtcagcaacacaagctccctgtcggcgcccatcagcaggtttggacgcgacagtgcacggtggatgcggttgcgctgcaggccggatggggaattagccatgagttccctccccgcctccggccgatccaatcgtggtgagctgttcgctcgtcagtcctatcgaggcgccggttgcgccaaacaggccgacgatgttggtggcgccgaggaggatgccggcgacgagaacgacgtatacaagtcgccgcgcgaaatcattcagttcgccgccgaagatgagcatgccgccggcgatggcgactgctgcaagcgcgatcgcacccgcgaccgggccggtgatcgactcctggatctgctgcagcggcccttcccacgggagactgccgccggagctggcaagggtcggcgcgaccgaggcgagaacgatgggcgccgccaagagcgcgacggcgatgaatgatttcctatgcgacatggcgcgcttcctgttcttctgtgagctgatcggattcgacctcgtattgaccgttgacgaaccgctcgacctggatgacgtcgcgaacgcgccgtccgcgcggcgtccgctcaatggagatcacgagatcgacggcttccccgatcacctcttgcatcggctgctggcttgcctcggccgtcagctgttcaagacggcgcagcgccgacatggcggtgttcgagtggatggtcgccacgccgcccggatgaccggtgttccaagccttgagcagggtcagggcagcgccgtcgcggacctcgcccacaactatccgatcaggacgcaggcgcatcgtgctctttagaagccgtgccatgtcgatcgtatcgctggtatggagcagaactgcgttctcggcagtgcattgaatttcggcggtgtcttccagaatgacgagccgatcttctggcgcgcttttcacgatctcgtcgatcacagcattcgcaagcgtcgtcttgcccgagcccgttccccggaaatgatgatgttgagcctcgcggaaatcgcgctgcggatcgtcgcggcctggtattcggtcatcactccggtccggacgtaatcttcgagcgggatgaggcgcgatgccctgcgccggatcgtgaaagcaggcctggcgaccacgggaggcaacagtccctcgaagcggtgaccgccgatcggcagctctccggagatgatcggctgttcggtatcgacctccgactgcagtgcatgcgcgacagtaccgatcaccatttcggccgcggccggggacatttcgccggcgggcgcaacgccatgtccgaggcgttcgataaacagctttccatccggattgagcatgatctcgacgactgttgcatcgtccagcgccacgcagagctggtcaccgagtgcttcctgaagtttacgcacaagccgagggtgagagcgaagctggttcacggatttctcctacgctgccttgctgagggaggtgaattcagagcgatagttggcgggacggagcttttgaaatgtactggcgtcggcgagtaggattcccgcgaccgccatcgtcaccccgaacttcctgggctcgcccaagcgctgaaggggccacccgacgcgcgcgaggatccgctcgaaacgcaggtcagtgacggtgacgatttcggtgaaaccgttcgacatgcaccattcgatgatgccggcgaacatggtcagcgtcgcctcatggacggatccgtctcccctgccctcgccgagcgccgtatcgacgcaaaaacgggagctctcgatcatcgcggaatgggcgttcaaccggccattcggaaggagtgagtgaaagacgtcggccaccattgtggggccaggcgccggaagcagccgcgcgcatcctgctacctggcgactgtcggaaattgcgaggatgtaagtcggtatcagagtgtcgaaagcatccaattccacgccgtcgataacttcgacatcccagcctagccggtcggcgaagacccgcgcgcgtagctcgtgatggcggtggataagctcagcttcctgaatatttttcggtgttgagatcgcgagaacctgcatgaatttctccgtcgtcgttgttcggcggagaactcagcacggtttggacacggtgagtagttgtaggattctacaaggtaagatccagctgagtcgcggtggtgagtctgctttagctggacgacaatgcggattccgtgtcgtctcctttgggttacgattgtaggattcacagtaagacaaatcatgaacatagctgacggtctggtatgctaacaggttgtattagataataaatccggattttgtgtgttaggtggatctgcggtcgttaaccttctgttaacgctatttcccttgcggcattgccagaatcatgcgttatcttgagacggcaataacgcgtctgacgctaataaaccgtctgaaacctgaggcccaagtgaacgtgatcgaccggcacattaatcgagcatcaacttccgcacacatcacccagcgcgcggaagcgttgtctgcgagactcagggcggttggtgagcgcgcgtttccccctaccgcacaaaagtcgcttcgatctttcacttccggcgaggtcgccgaaattgtcggcgtgtcagacggctatcttcgccagctttcgctcgatggactcggcccttcgccagatttgggaagcgccggtcgccgctcttacactttggagcaaatcaatcaactccgtgagtatcttgccggagctcgacctaaggaagcaagtagattttggccacgtcggcgcagtggcgaaaaacttcaggtgatcacggtcgcaaatttcaaaggcggctccgcgaagacaacaactgctgtttatctcgcacaaggacttgcgttgcagggctaccgtgtcttggcggttgatcttgatcctcaggcttccctctccgcaatgttcggttatcagccagagttcgacgttgccgaaaacacgaccctttatggtgcgatccgctacgacgaccagagggtgacgatgaaggacgttatccggcgcacctactttaccgggataagcattgtcccgggtaatctcgaactgatggagtttgaacatcagacccctcgattcatgctgcagaatcgagggcgtccggaggatctatttttcagacgtgtcgcaggcgcaatcaatcaggtcgaacaggacttcgacgtcgttgtcgtcgattgccccccacaactgggctttttgaccatgggcgcccttaacgcagcgagtggcatgattgtgactgtccatccccaaatggtcgatgtcgcatccatgagccagttcctcttgatgacgtccgatctcgtgtcggtaattgaagaagccggcggacggctcgactacgactttctacggtttcttattacgaggcatgatccgcgcgacgtccccgagcaggaaatcgtggcgctgcttcgtgacgtcttcggaatcgacgtcatggcggcatccgcatggaagtcgacggcaatcgccaatgccggtcttaccaagcagtcgctctatgaactctcgcgcggcgcggtaggacggacgacgtatgatcgagcaatggaatccatcaatgccgtgaatctggaaattatcgaccagataaacaaggtctggggtcgatgatggcggctcaatcgctgataaatcaaaaccttagtgtgttgtcagctgactacacggtcttactagaactgttgtttggatagggtcggaacgatgagcaaacgtacacaatccattcgctcaatgtttgccgggggcaacgatcagaccgcttctaatgacgcacagcagcctgtgcagcgagttgcctcgggtgcggtccggtcgttgaaagacacgttctcagaggtggaaagacattacgaagagctcaagcagcaagttgctgacggagctgttccagtcgaaatagacccagaattggtcgacccctcgcccttcgcggaccggtttgaggaccaagacatggctgtcttggaggtccttaagacttcgatcaaagatcatggacaagaaattccgatccttgttcgaccgcatccagctgagatcggacgatatcaggttgcctacggccaccgcagactacgtgcgactgccgaactcggcttgaaagtcaaagcctatgtccgcgaactggatgacgatcgtcttgtcgtcgcgcagggcattgagaattccgctcgtgaagacctgactttcatcgaacgggcggcgtttgcactcaaactggacgagggtggttttcaacggtcgctaatacaaatggctttgtctgttgaccgacacgaagctcaaaagctggtaacagttgctcgggcagttccgcagtggttgattgattccattggccgtgcgccgaagatcggtcgaccgaggtggcaggagctcgcagaacttttgaaagtcccgggcgcagagaagaaggcccgcaaagccacccaggacaaatccttctcacatagggattctgacaatcgtttcctggtcgtcctaagagcgtccaagatagatgatgtgacggcgccgtctgtagcccccacccgcttggtcgcaaaatctgctgacgggcttcaaatcgcgacgctcgccatcggcggcaagcagtgcaaaatcgaaatgaaccgagatagagacgagacttttgcaaagtttgttatggagcagcttcctgcgctctacgcgaacttcagaaaggaaaatccgtcatctgaaggataaataaggataggaacagcaaaagaaaggcccccaaacgtcgccgtcgtggaagcctctctcaatggtctaagcagcctgagaatcgcatttccatgaatcgcagtcaagagtctttggcaccgtttttggtgagcagatttcttttgcctattgaagggtgaaagacatgcagagtggaaatgtgacgacgccgtttgggcggcggccgatgacgcttgccttagtggcggcacagttcaaatccgccgacatcaggcagggtaaatcggccgacaagtggaagatctatcgcgatgcttgtgacgcgcgatcattgttgggtttgcgcgatcgggcacttgcagtgctcaacgcgcttctatcattctaccctgaggctgaactcaaggaggaagcgaatcttatcgtgtttccgtccaatgcccaactcgcggcacgggcaaacggtatcgccggcacgacgctacgcgagaacttggccctcttggtcgatgcaggtctcatccaacggaatgatagcccgaacgggaaacgctatgcgcgcaagagctcagatgggtccatcgagacagcctttggcttcagtcttgcgccgcttctggcccgatcagaagaacttgcggttatggcccagcaggtcgcagagggtaatcgcaagctcaaaatcgtcaaagagcgcatcacaattgcccgacgggatgtccggaaattgatctctgcggcaatggaagatcacgttcccggggattgggccaaggtcgaggagctttatgttgaagccatggcacggctgcggcgggcaaaaggggcggacgaattaatcggaattctcgacgaagtcgagatgctgaaggaagaagtagtcaatctattggaacggcacgtcaatcttggaaaatccgacgccaatgatgacggattccgtcagcacatacagaattcaaataccgaatccagcaatgaacttgaaccttgctctgaaaacgagcagggcgcgaagcagagtaaaaacgttgaactaagagccgaatcgataaaatcattcccgcttggtatggtccttcgggcatgcccggagatttccatgtatggtccgggcggagcaatcggcagctggcgggaccttatgatggccgccgtggtcgtgcgatcaatgctgggggtaagcccgtcggcctaccaggacgcctgcgaagtaataggggctgaaaacgcggccgcaatgatggctgcaatcctggagcgggcggggcacatcacatcggccggtggatatcttcgcgatttgacgtcgagggcgaaacgcggcgagttttctctcggaccaatgttgatggcgttgctgcgggccaatggcggcgaacaaaggcgggcttaatcgcggttccaaattatatcccttgaaaaacattagtgccctttgaaccgccgctttgttttgttgtcagctgaccacaagctaaattgttgtttttgctacttggttgcaataatagcattctaaggtgcgattttacttcgcagatccattcagaatggcggcccgttcaggtgcgtgagcgaatgcgagaccttatatccatgcggacgctccgcgaccacatatttggatgcgttgcacagtggggagtcatatgttggcgaagcttggatgcgatcgccgaaagcagccttctgcatgcagccatcccagccagtaccttatggcgtttttcccggagaccggtgttgccaggcggtgggccttttgcttgcgcagctttgatgcctggtttcgttcgcacggagatcggtacgcgctcaacttgtgctgtggcggctagtacctagagagaaagacgctccgctgcgtcgatatcccgatcggacctcgcagcgaatgaaatagaacctcttcaagtcgatccttcgatcactcggaagatggctgacggagtggcgagttctcgcttagaccaatattgatggctttgatgcgttctcatgtccagcagcgtcgtgttggctagcaaaaccaccgaacccgggcactacaggattcgaacacatgagaactggtttctagattggagaagcccgacgactatgtgttcagatcgattgtattatcacgggtcgtgccatctgattcatggaattagtccgtacaggtggcaagaacaattgactcttggatcgcgctggcaaacaaagcagcgatgtacagaggatgaataattgctgaccaagaaatccagacccaggatggcgccgtagcggcagaagctgagcccgctgctccgaaaaagacttcaaaaaggaaataacacgaaggctgaaaaaattcgtgcgaatgcgtcgaaactggcgaagcagaaggtccgcggccttaccggggaggaaaagctggaaaagattggtcagattgaagctacggtcgctggcggcgcaaccttgaagatgccgtgaaaagcgctggtatttcggatcagactcattatcagtggaagaaggctttggctcaaccggcgccacccgtttccgcagcatctctttcggtggatgacgaactcgccgaattcatccagctcgaggaagaaaatcggcgcctcagaaagctgctctcagagaagctgcgcgccgaaaacgctgatctgcgcaagagacatggtatgagttagcggtctttcggtgtccatccctcgatcaccttgacgtgcaatcctcgggattggccggtttcaaaaattcccgtgcatcctgatcattctgcgccctcactcattccatttcttaggaacatgcgaacaccacgatccaatttcatcgtcgaatataagacgaacaggcgccagacacttcgccgaacctcaatctggggcgatctggatttgcaggctgttgcccgcgcggtagaggctgacgatgtgatgccaaagcttgatctgcctcaagcagcatcagttcaggaggacgttgtcgcggtgaagttcgaggtggtagactactcggatgttccgattgacggcgaagtccctccggatagtcctgccgcaacgtcgtcgtcgaaagagttttccatcgagtctgaagctgtggaagacgatgcgtccgaccccacgcgctcggtgcatcagcagcgtagcccgggttcaggatggactccgaagtctggagcgaaagcacggagtaagaagacgccgtcagcgagccccgcaagtgcaccaattctcaatcttcgccgcgatcccccgctgctgtgcggcttggatgaagagctcgccgctctcgaggctgaaaaccgccatctgagaagcctcatggtcgtgaagctccggaaggagaacgaaaggctgaagttcatgcttcggcgatttggtcaaagtcgctaagtttgattactagcacgaacgagtatgcgcatcggtcggcgaccgctgaacccgcagtagcaggcgtctaaggcgggaatctcgtaaattcggtggttgatggtgtcgtttggcatttaatcgtaagaacgcggccgttccggcaggtggtggcatttaatttgagattttcggtgcgattttcggcgtctggcaccttccgatttggcaataaccgtttgtgacggtttagcattttctgaggacgattggccgacggcattcatcttttccatggcgacgaatctcaccttaagtgccaatcgaagcctgaatctcaaaattaactgctcaatctcaatttaagtgccacgctatcttgttgaaattatcgcatgcggagtcttgcgattaaatgcaaaacgacacaagactcccattatgttgtcgtccattcgggcgcctccccggccatctttcctacgctgcgaccgctctgtcgacacgatcgccttgacttggtcttggccactgtgctcgtaagcaatgacgacgtggcgagccctggacacgacttagccgttgtaacgctcgatgaggtccccggtggacggcccgaacattctatcgaatgtcctgctgctgtcgataggccattcactgcagccaaggtcggaacacgttgaaaggtgggggggatcgtactactatatagttggaacgaaaggcgatcagcttcgatgcagatagtgtggacatttacagcgcggtcatacctcgaccaactcgcatcggaagagaaagcaaaggtggtcaacgctgttgaacgtctgtcgcgcggcggacgatcctcagctctggagcaaacaaagctattgctcgggacgaaagatctcttttcccttagggtgggagccgagttgcgagtcctcgttcgcttcgagggcgaaaatctaaaaattgaggacgtcgttaggcgtagccagctcgatggattgcggagagttgagaggttggcacaggcccactctgtatgaaatcctttgtttccttaaatcttgatacttcgatcttacgacaaaacctggacgaacttgacgagctccttaaatccgagagccatctcaaggaacgggatcagatagcgccattttttaaagagcgcccgcatctctgcgctgctattggctacggaaacaatgctgtcgaactacccaactgctgggcaagcgaactcgacttgtttggcgatttcgtgtgcgacgcggcttctggcgatactgaggcgaatgcattcacattgatcgaggtcgaggacgcgcgagaatacagcatctttacaaagctcgaagccggaaaatcaatgaaacactggtccaaccgatttgagcacggctcgtcgcagttggttgattgggcgtggcggctgtcggaagaaaaaaactcttccgcattcagacggattttcggtacgaatagcccgacaattcacctgcttctgattgtagggcgtgatgcggatctcgtgccagatgatcttgatcgacttcgctggcgtgctaacaatgttgcctttggtggttatcggatgtcgtgcttcacctttgacggaatactagcctcaatccgtcgtcgtcttcttctggcaagccagccgtcagaggtaacctgaaacgtttgcgagatccggctgaaggcgccaagcccgcgatcttacaacggccccggcgtaacaatgaaaacggtcatcatctaaattacagaagtgctcacaagcccgagctaagttaggctgcttctcctgagtagtgccgtttgagatagacttccatccccaactgaatttgcgcgaaccaaggtcctgacagactcataacaagcgcgccgcgcgtccacaccgtctggtggcattgctggatgcctgttgaatcgagcgatgacgtgactgctccatcgcctcgggtaggggaatgcctcggttcgccgcctcggccagatacctgaccgcaacccatgggccgaaaactccccgctctccaacccggccatctccaccctctgcttgataacggcgttgaccgactgcggatcgagcgcccgccgcgaaattgtcccccagcgcccgcccccccccccgaaacacgctgcccttgtcgatcttcccccgccgccagccaggcattcaacgcctcgacaggccggccggtgagatagacgactcgtcctcctcgcctgacgtcgttttggtacggccaagatgaatggcgagagaggggaggggagtgccgccttcggtctcgatcggagcttccacggtcagttgttccaggcgaaggcctgcgatctcgctgcgccggcggccgccggaggcaaaggcgaccatcaggatcgcccggtcgcggagatcacgcgggctttcggtcgcgcacgtcaccaacagcttggccagcacgtcgccggtgaccgcctttgcgcttttgcggcggcgttgccgcaggacggcgcgcacatccagacgaacggcggattcgagggcaggggagccgaaggcgtcggtaagcccgcgccatctggtcagtgtcgaccagttcgccagccgacggagcacggtcgccggcgcatgtgggccggcggacttgaggaatccctggtgccggaggttttcggccacgtctgccgggatgccgtgatctgaatcggcagtacgtttctccggatcccacaggtgatgggtgacgaatttcaggagcagcgcttcgggcgccggccagggtagagattttccggaggccgccagaccccaggcttcgaaataggcgagatcggaggtcagcgcccggagcgtattgtcgcccatgcgctgtgtggcttttagctaacaatttcaattgaagcggaaagctaaaaatccgacacgcaatttgccccaacgagttcatagtgagcaggggaggggcctcaaagccctgtggctttggtgagattgacgcgaaagcggtcacgccggcgctggtatttccgcgtcatttccgcactggcatggccgagctgcttctggacatagcgctcgtcgacctccgcggaggaggccagaccggcgcgcagcgagtgaccggagaattttgccgcgcgttcggcctcgttgaggtcgcccctgacgccggcggccagtgccgcctttttgacgagacgggcgacctcgcgatcgttcagccggtccggtccgacatccttgccctggccgcggacgcggcggaacagcggacccttggcaatccgggcgaacttgatccaggtttcgatagcgagaaccggacaggtcgcatcggacgagccgcggccgacttccacctcccgccatccggtcttgccgcgcagggtgacgagcaggcccttctcgaggatctcgatccagccgcgcgcgtcctcgctctggtcgcggccgatatcgagcccaacgatctcggaacggcgcagaccgccggcaaagccgatcagcagcatggcgcgatcgcgcaggccgcgcagggttcccctgtcgagcgtttccagcatgccgatcaggtcttcgggcaggagggcttccttctgccgcggcggggcggcgtgcgtgttgcaaatgccagccattacggtggcgatatgacggtccttgcggtcgagcggcgtgccgcgctgggcgtagctccaggtcagcgccgaaaggcggcgctcgatcgtcgtgacggagctgggcttgcgatcggccgcagcagtgccggacgcgagcgccgtaatgtacaggccgacggtgtgcggatcgggcggtaggggcgcgagaccctggcggcggcaccaagcggaaaagtgcttccagtcggaggcgtaggccttgcgggtgttggcggcgctcgccgcctcgacataggtacgggcgcgttcggcgagctgctcgaggtgcgccggcaaggtccgcgcctccggaagaggggaggggaggccagcgctggccgtcgagatgccgaccgccatctgcggcgcggcaatagcgtcgcgagcggtcgtgctctcagacggagaggaggtctctgtggcgtgattttcgtcgttttgctcgatgatatgggccattctttatataaagagcaaaacgtccgataatgcaagattatcggacgttatatatccgcgacaagcggtgcggtttaggcggataatgctggactaaaccgctcacctaatctacactccgtcgcatggattcgttcgacccctccgctccaaccgcccccgcctggtcgccccgcatgccgggatgggcactgccgcgtggtcgcgacatcactgaatccgacgccgccttcgccgccggtatcgccctgaaatcgctcgatgatctgatccgcgccgatccgccgtggctcggctgctggcgcgatcgccttgctctcaaatcagctgccgtcgccgccagaatgcttggccgcaatgaagaggaaaccgccattcgcgacgcgattttgctcaccgcgcccggcaacgatcccgggccggccggaaagctgtttcttgccatacgaatgctgacgcgccaatccgggacgattgccacgccattcgttaaggagctctgcgcgctgctggggattggctgggaggatgctcttgtctccgtcccggattttgtcgatacggcgatccagtccgggcgcgcggcacccctcgcagttgccgagcttgtatcggcgattacgaccattcgcccggacaccgaggtgctgtcgcttgggctcgccgagatcgttctggcgctaatgctgaactggccgaaacccgtaccgctgctaatccccgagcggtttggcgaggcgttccgcaccatcggcggccgtggtcgcgtccggtctggcgaagcggcttatccgagggcgatctgcctggctttgatggatggtgtggcggcggcgctgcgatctgccgtggagatcgatcgaagggcagcgcggttgctggctgtggcaccaaagctccgtaccaggggcgccgagccggtgatccggcgtttgctgtccgacgacgctattctggcgtcggtcccaggaagcgagctgtcgcgctgggcagcgaaccggctgttcgatcggctcgagagttttgaagcggtgcgcgagctgtccggccgctcctccttccgcatctttggattatgatgatgaggggagcgagcgcgacaaaaaccacactgcgtcgggcaaaagaccgacagcaagatgtcctgtatgatcgcgagctcgaggacttaccgcaagaacttcgttggcgggaatggatgctgcggattgaggcggtgatctttgcctcggctgagccggtcagccgcgagacgctggcgcgtgtggtgggaaaggattgtagcattgatctgttgatcgacgatctcgtcgaggagttgcgggatcggccttacgagctggtgtcggtcgccggcggctggcagcatcgcacccggccgcggtttgccgagacgattcgcgcgtcttcggccccgacaaggggaggggcggcggcactctccgagttcgaggcgatggtgctgatggcggtgggatatttacagccgattacccgcggcgagctgtcaaagatctttgggaaggaggtcagccgtgacgtcgttggtaatctgcgcggggcgggttttatcggctccgggccacgcagtccgacgccaggcgcgccctatacttacataacgacctcacactttctttcggtctttggtatggagacgttgcgtgaccttcccaatatcgaagcgctcgaggacgccggcttgctgagcagacgtgccgttcaagatgatgtcgccttcgatccaactgaaggggaggcaatgttcattgaatgaatgagggcagcgtacttctgcatttgcgacccggacgaaggcgctgtgacgggagcaaactgcagaatttcgtcttggacaaccgtgctgtcttccaatggtccgtccgagagaccttctaaggcgaagtccgaatgggaaacaggtccccgccgtagtggtgaagcctggtgtgatggcgacggcatagccatcggacgttcaatggctcgtcgtattgatcgtgatgagcatcgacgtcttcatcaccacagacctcacacgtgttctttctcagctcgcccgccttcacggcacgctgcaccaagaggtgagcctcatattttgcaggattagcacgccgccaattcgcttggcgggtatctgtctttagcatctatctagtcttcccgatcagttcagggtgtagcgcttccagggtatcgcctgcattggcacccgcgacagaaaattaacaagatcacgtcggccacgatatgtcggtacgcccctgctgttttgtgccatgagaacaatcggcacgcccgggaatgctggctggaagctatatgcaacgtcgtcggcctgatggccgctgttcaaaacgtgcggcttgacgatgactatggcgaaggtgacgccctgctcgcgaactaatgcgccttcaaactgcatttcttctctcctttgatgaagaggccgcctcactccaggcggcctcaggttttagccacgcggcgggaacgggtcgcgaccgtaggaatccttgtcccggatttgtccgttgggacggtggatgacgacttcgctctgctggttgatcgcaattttgcgagcagcggcagccgcgtcggcctgcgttccatgggtggaggtcactcgctgatttccagcgccccgcacggcccattcgccgttatggggaaccacatgctgattcttccttgtcattgcatcagaatcttttttcttgagtgccgtaagagtttacattaaggaaaatttaattgtcaatatggctattgtggtttacgaatggatgacgaatttttacgcatggagtgatcatgaccattgagatgaaaaatgtgctggagttggccgacgcggcactttccgctgactacacgcgcgtacgcagagctgcgaatgcgcttgcgcgagatctcgacaagaatggtgagacttccattgccaaggagctgaaggccctggtgcgcaagaggggggtgcctttgaaggcgtctggctacgtggaatcgctgcccgtggactcgaaatcccgcttgccgcttgtcgaggagcagacctggcccgatacgcctatttttctcaacgaaggcgggtggcatgtgttcagcgatttcatcgcggatgctcggcgcattgatgacttgagcgccaaaggattggcctcacgtcttgggcttctgctctctggcccgccaggaacaggcaagtctctccttgccggccatatcgctgcgcaactgtctcgtccgctatatgtcgtccggctcgactcggtcatctcctctttgctcggggacaccgccaaaaatatccgctcggtgtttgatttcgtgccggcgcgaaacgccgttctttttctcgatgagatggatgcagtcgcaaagctgcgtgacgatcgtcacgagttgggcgagctcaaacgcgttgtcaataccgtcattcaagcgttggacgggctagacccgagctcgatcgtggttgctgcaaccaatcatgcgcatcttcttgatcctgcaatatggaggcggtttccttataaaattgaactcggtcttccggatgaaagcgttcgcgctgacctttggcgccattttctcttcgaggacaaagatgaggagaggcgcgccgagctattcgccgtcgtgtccgaagggttgtcgggggccgatatcgaaacgatgagtctgtcggcgcggcgtcatgccgttcatgagtcgcgtgatattgattttggagccgtcgttgtggctctgctggagccgcggtcaggccgtactgtccctgtacagcggcagccattggatgcggagcagaaacgccaggttgcaatagccctcaaggagaagtacgccattgggggcgcggataccgcccgcattctcggagtgtcgcggcaagccatttacgcttacctgaagcaacaggaaggggaggtgtagtatggtggagcctagagaccaacctcttctctatcccgttctgagccttcagatggatccggcgctgcggagtccgacggggcgtggcaaaggcatcgacagcatcgtcaaggagcggctcggccggcagcaggacgtgctcgcgagcgaaacacgcgacatttatgaacaccgtacagagttgcccacatactcgggtttgacgcacctagtcgttcggatgttcagtgaggattcccttgctccaacgcacacccccgatgacttgttctcgcagcgtcatggatgcaggctagttgctcctcttcctggcggctatttgatcgaggctgaagtcaaagaattgcctcgcctccttcgcgcaatcgaacatccaatcggctatgcggtgcaagccgacatatcccgtgtttcgtctctcggacaatttgatgcgaaaagtcgtctgcgcggtcgatcgttcaatgagctctggaattccgcaccggaagatgatgacggacgcttgttcgttgtttggcttgcgccgttccgcgatcgagatgccaaggccgaagtcctcgagcgtatccagcgctttgccaatgagaggctggtcatgccgacatttaccagcgtgcggctcacgctcggaacatctgaggaatcggaagaaccgcgttctctcacgacaccacgacaatccagcattgcaagggcaatgcgagattatcgaaacaccggcgtcggacgcgctgcagttcgaattccgaataaagaagggttgagacagctcattgcgtcaggcgcttcttatcgcattgatcctgtgcggccgatcagagtggcagcacctggcgaaggagcggagcctcctgcaccagtaatcgatgagaatgctccaatcgttgccgtcgtcgatggcggtctgcatgcgcgaagctacaccgcagctgaagctttcagggcgacacctttcgtcacgaacgcccaagccgacaagcctcacggaaatagcgttagctccctcgttatccatgggcacgcctggaacaaaaaatcgctcgctgcctcaactaaactgccgtatcggaactgttcaggccgtcccccatcggaacgccaatcggcgctttgatgagcgggagttggtcgactatctggcggaggttgcgcgtctttatccagaagcgcgcgtctggaacatctctgccaatcaggacggcgccggtttggatcccaccgaggtcagcgttctcggccatgaaatcagccttctcgcgagatcggcgggcttcctccccgtcatctctgtcggaaatgtcaccccagataacaattcaagacctaatcccccagcagattgcgaggcggcgattgtcgtggggggccgtcaggcgcttgctgacggtacgccgggtgacagttgccccgcatgcctgccaggtcccggtcctgacgggatgatgaaaccggacctgtcgtggttttcgaatctcaggatgctgggtggggtcgtggatacgggaagcagttacgcaacgccgttggtatcgtctttggcagcccacaccttcgatagcttacgggaaccaacgccggatctggttaaggctctcctcatcaattcagccgagcgaagtgagcacgatcccaacctcggttggggaaccccgtatcaagggcacctcccttggacctgcgcgcccggcagtgtcacgcttgcgtggcgggcacaactcgagccaggaaccgcatactactggaacgatattcccatccctcccgagctggtgcgtgacggaaaattgttcggacgcgccagcttgaccgctgttttgcggcctctcgtgtcgccgtttggcggcgctaactacttcgcttcccgcttggagacatctctggcgtatcagtcgggagcggataggtggccgtcgctacttggctcaatgaaagagtcgacgcttccggaaaacgacgctcgcgatgaacttcgcaaatggcagcctatcagacggcactgcagagacttttcaaaagggagcggacttggcttttccggaccatacctgcggctttacgcccgcgtgttcatgcgtgacctctaccaatttgggtggacgcatcacagccaagcgggcgcgcaagaagttgcgttcgtgctcaccctttcaagcgcggacggagagaagtcgatttatgattcaacagctcgtgcgctcggaaacttcgttgaaagcgccgtcttgaaccaagacatcgaggtctcgaatgagatctagctggtcggtgtcctccggatttgcgattgggcccttgcaagcgaggcagatgcgtgaggcgtagccgcatttccatcggtttttccgagaaggaatttgccgaagcgttggcacccagggtcgctaccgtgggcacgaggccggtggatgccgttgaacaactgctcacacaaattctcgtcgaaaatcttcggcagcaaacagctttggcgctccggaagatcccctcggtgaagcttcactcgatgtatttcaaggagcgctgtgcatccttagcgcggcttgcggacatcgggtacgacacctggtatgccgaactggccttttccacaaccagagagaacatggttgacggcgttgagattgacacacagggtttgcacctaagtcccataaattgtggccctgcagggctgatcacacaccgactttggtcgaagcagctaaaaacgcaaaccaatcacatcctgcgtttgaaccacgtgacgattccgcccagcacgtttcttgaaaccaagaaaatgatggaggcgatttgccttgagcagccgctggtcgcgaaccctcgacctggtccgcgtacgcaaggctatgagtttgggatcgagggctttgagtttgttgcattcgatcatttagttaccgggaagcgttgtttctgttcatgcgctcgcctagctcatgaaaagatgatgtcagaggctataaggattgcatctcattcaggcgcatggacccatcaggttgttcgattgttgtcggatgcgacctacatcgacgaaatatgccacctgtgtatcgcccgtcgctcgggaccggaggctgctgccagcttctacggtgatgatattggggaatttatcacgccgtatatcgatcagctgatgttgatgtctggaatggacaagtccactgcgcgttccgaagtccagtacactcttggtgttcgccgatggatgagggaggcagaaatgtacagtctggtgaaaaagctatttcccgaccaagttatcctgagggaggcgtcgcccccatggctggggcgccaacgatttgacgtgtatctgcccgccatcggccttgctctggaacaccatggtgagcagcactacagagccattactgcatttggaggagaagtggcgctaaaacgtaacatggaacgcgacgccttaaagagaagtctctgtgaacaaaatgccgtccaacttgtcgagattcgatttgatgagcaaatgacactaccgcttcttcgccgaaagctgcggcgtttcattatggcctaaatgtatcaatgacggccgccttcacggcgataatgtgagatattgatttcagtcgcagcctggggtgtaaaatgttctacgaacgcggatgtaacagaatatctcgattatcatcttgcttcggaactggagaccgatttcgcgattatgttgatcggcccttggggagctgtaacgatgccagtcacgagagttgagcgaattgtcggcggcctggtcatcggacgtgtcgaacgcggctccgacggctactacgcctgtcatcatttcggatcaaacgtggatcccttaccccttaataccttggacgatgttgcggacttccttcgagctcatcctcgcggcggcgtgcgaatgtatccaggtcggaagaagatttctcgcaacatctatatcgatggaattttccttcggtgacaggtgcgcgaccgccgttgtcctgatagttttggaggtcgctactcccgatgctgacgcattgaatgtatcaggctttcatgcattacggatctcctaggaacggtgggcattatgcgaagagacgaggttggggaggacctagtgtctctcgcctttgactttctctatttttttgcgcgtttcgaatatgcgctcaaggccaacggttacctaaagaaaacagagccaggtcagcccgcggaggctgggtggagacaatttcgagagcgctgggaaggagattataaaagcagcgaagccgctgtggcgttgatcgcggctaacccgaaaaagcagatcattggcgacgatggaatgctggcgtttagagctgtgggttttcccgccagtacttgtgagcttgggcaggttatcggctattgccagaccgtccgtaacaacctctttcatggtgggaagagcagtaccgacggcttcgatagcccggagcgtacgaaatgctgctttccatcgttctcgtcgtgctcgaggaactggccagcgctttcgatcttggtgctgactataccggctactactaaaacgctcatcgatgaagagtagacgcaggcgcttgataggcagaggcgtgaacgtggaatgtcgttcaagaacgcagcaggcgtgattttttactagccaaccttgatgtgcatcaaaatgtgcatatattgtgcataagattgagcggagattaggcatggcgcaggctcagacagtacattcatacacagttgtttccggctttgttgatagccttcaggaaccgcggacgccctatatttcgccgtctcgcttgtcaaaggcgctcggcgtcaaagtcgcaaaccttgcagaattgaccggtgtccatcgcaataccctgcgcaatccctcctccgaacgcttgcagggcaggatgcgggaaatgatcaaggcgatctctgcggccgccgagctgactggtgatcttgcgaaggcaatctactggtatcgaaatgaaccgattgccgattatggccatcgcacggccgcggagcttgttgccgatggtgagatagaggctgttcttgcctatattcgggacctggagaatggagcgcgcgggtgaagattacccgcatcggcccgaacgcagtctttcatcggtatctaacacctaaatgggcgtttcttccaaccagcggcgccggggccgctattgacggcggtcgcttcaatcgacccggcgtcgaggctctctatctttccgaggccccccaaaccgcgctcgaagaatatcgacagggcgcgagcatcacaccgccggcgacgcttgcagcgtacaagatcacgctcagcgaagtagccgatctgtcgcaaggtttcgatccgcttctttgggatgcagcttggtctcaatgggattgtgcatggcgaaaaatcgctcgcatcgacaaaaaggtccctccctcctggaagttggcagacaaagtcatttcatccggccttcgggggctgctctttccgtcactaaggcacgctggcggaactaatcttgtaattttttctgccaatctcatcccagatgatgacgtgcatgttcacgatccagacaatcgtttgccgcgcgatcaattgtcctggccgcactagcagcaatagatgccggccggcttcgggggaggggaatgaagcgcattagtatcaaaagtgttcagcctggagatattctcctcacagctcgaccgggaaagataagcaaatcgatccgcttcagcacggggggcatcgtttcacacgcgatgatctgcgtgcagcatggttcgtttatcgattccaccgcggacggggtacaggcgcgcaacctgcagcgggagttgttcgaggatgacgagcaggttttccatttccgcctgaaggaagctctcccccgcgaggtactttcaaatgtaatcgatttcgcgcgggccgagatcggtgcgcgttattctgtgccggaggccatgcggtcggtcgctgctgtccgaaagccgagatcgaagcggcaatattgctctcgtttagtggcccgcgtctacagaaacgcgggcatcaatcttgtgccggacgcagactattgctcgccggaggatttacgacgtagtcgcttgctggtggaaatcccgatagagaccgaagccgtgtccgaggaagaatggcgttggctcgaaaccaatcgtaacccgatccgagatacacatcaggcccacaaagccattcttgacgtcgctcgtacgttcgttccggacttggagagcctaaacgaactccatgctttactcgtggttcgccctgaggctgatccggagattgcagaggttctgcgcgagagcggctaccttgatctgtggcgcggtgaaatagcggctcacccttggcgctacgaccagagcctaatcgcaacgatgtccgcgcccgagcagatggccgacatacgtgaatactgcataggtacagtgagcgaggcttacagcggaggcgtgcggttttccattaacctcatacagttgcagatgctagagacccagcacggcggtcaatccctccggctgttggtggacctgtacgaaactcttgtgcttaacgatcagatccgcagggaggtcgcgtgtgcgtggctgttgaagcactatcctgacgacctgaagaaacagttggagcagatcgagccgcacagcgcctattggtattcggtcgttgatcgcgtcgaaccgaagctggccgcgttgtcgcgcatggtcgtcacggcggaaggaagttcggaagtctgctcgtcatgcggcgaccggccagccatgtcctaccgtcttgcgaatggcgctcagacgatgccgggcgtaccctccctgcgcctgtgcagcgactgcatcgagatacggcgcggtatgggcaacatcctgatgccgttcctgcattgacttggaaagagaatgggaccgcaaacgaaggctgtgataaaagaggatgcgctgctttgggtgagttaggccgttcaggaaacagtgttctggacccagcgcaactgcgtcggatcgaagccgtgcatcgcggctacttattccagcacctctatgcagttcaatgtttgttgtcagccgcaaccatcgctgcgcgggagatcgctgtcgaaagcgacgaagatgtagaaatccaactcgatggcatccgtatctatgtgcaggtgaaacatcggaaagatgcccttgcgtgggatgatatcgagggcgcgatgtcacgttttgcggaccttgccgctgattcgacgttagcctaagacctatcgaccggctatagccgaagaaaaatagcgggatatatgcgccgactcgccggctgtgttgatgaaggctagctcgcgcgatcgtggccgtacatgcggagccttttaactagcatcgttgagaaggtggcgcgtttgtgatccttaatcccgcctgccgtgttcatgagcagatccgtcaacagcgcattcgtttttctgcaatgcacttgaagaagccgattgccgtgatatggcgccgtgtccagtaagattgccaatctctgcgccggcgggaggggcctattccctcgaccatcagcgacatttagatcgcgacaagtagcgtcacctcgcaaagttggagaaaaagagggtggctgtatttgatccgctgggctggcaggggcgctagcgttggcgctcgttcatgcagccaacctgcatttcaagtgttgcaaaagtaatagattagcagtggagacgcccttttcatctgagtaaggttagcgtgattgaagaaaaatggagcttctcatgccgtccagcagccaacgaacacctccccgagaatctgagtctgctcgggtgaagagtgatcctgcgtcaccaaaccgaaacctaccttccgatgtacttgcaaaagttgctacctacgttccaacccaggatgtggtcgaaaccgcacgagatctcggaaatctagagcgaactggctccgcaggtcgcgaagctttacgtcgaggccctatcggaatttatcacgctcgcgtgaaaaggattggtacatcggcaaaagcagtcttcgatacaatcatccctggggagcaattgcctgattggcaggtgaaccggccatctgaaacggcaagaacgcgggcggtaggaccacttctgaagtttcaatctgaggctggaaaagcacgattcacaaccaacatcctgaacctccctcagcctgatcagtgcgacgcaattctgagcgtgataaagcatctggacgatcttggggaagtcaataagacgcgcttaatcgaacgttcgatcgaaatcttgcagcttgatccccctcttacttggaaccagggtcagaaatgccccgccgcagacgtattggtccagggcgagaagcacttaaacgacgaccaaaaaactcgggtacaacacgagaggaacaatcgcccggagctgctgcgcctgttccgccgggctgtcgcagactttgagattgaaaaaaacatggcggcgcatccccgcaggtatcaagacgcgaaagaaccggaggtgaaacctatcgacgaggtgattgacataatcgaaagatatagtcgatcggtcgtgacgagagggccaaatgctatcggccttctgacggcacacgagagtttcgtcaagaacgtcggtgatgcctacacccgtacgcgcgccgaattcgattcatcctcccgcgatcgggacagatcggcattgtcacggtaactctcggcagccgttccgtgttggcgtgagtggagggattacaaggtgacttgtccccgctgtgctccaggtttcattcgtgtttggtgcagtcaatcggcatcggcctcgttgcaagctgtgctggtccgaggaatgaggattgattggcacccggaacggcttttccaaggggaaaacgccagccgcaatccgcagtaggggctttcatcgtgagattgacataggacaaggctcgaccggagatgtagaacaggagcgcgtgggcgtgctgcccgacgctcgggtcgtgcgtcccaatagccagccttggattgctatcggagccggaaaatccaacactttgtttgtgtacttttctaccacagcactgaatggtgtgccgtcctgcagcttcaacacggcacgatgttcgagaagaaacggtggcaggaccagtggtcctctccggttcgcagttaattcatttcccatgtcccagccttctggtagaggagaccaaagcagattggaagataggttggtgcgggtgaagttaagagactgaacggccctgccgaacgctatatcactggtgctcaacgcgttattcatttccattgtcagtctcgccggaacataccagttgtcggcttctgatagtacgcgatttccgcaaaccaggcgaacgcggcgataagcgataggctcctctgatcccacggcaagaagttctcggatactgctatcggcgggcgtgtcttgtacgcgcacgcgctgggcaacgatcttggagtcttccggggcgagtttgtgcgcggcacaccagcgatcgagcgtcaaggtggcgctaggatttcccaggagatttgcattcaaggtctggagaactgcgagcgcctcgatccgagcggttggtgtgtccggccatggagaggcggtggaagattcttgtgccaaggtattcgcggccagcacgagcgctatagtcgatgcgattgctgttacctgcacagactttaagcaaaaattcgacatactgaattactccctggatgtgcgtgggcgagttgaatgttgatcttggggaggactggaagcatcgctgttcgcggagtggccagcggggcagtttgttccggctttcgtgtctgctcatgcatcttccgccggccgcccaatcgttctgattgtccaccgttgagttcagctcgtttggtgtactggaacttctagcgttccttcgaggttggttaaatgtcaatcgtgttacaaatgtaaagcattgccttcggacgcgttgccgttggatgtcataccgaaaaaactacgttggcttctcattacttcaggaaattcgagtgcactttgtttcggattaagacgtagatgtatgtaccaaacggctttcccccggtcagtcgcccactcccaccgcattgacatggcaatttctgcagtcggttattgtatcacgacaagccataccgctttgaggcgccaaggcgtcgttggaagtcgtcatctctcgacattggcaatggggtgcgggtagctttggaacatttgatctgaatccgcgtcaggcgcggcgcattcgtaaacgagaaccgattcaagcgtcgccgccttgaactccttcggcgagtggccgccatcagttctcatcatcgtcttttgctttcgaagtgaaagcttcatattgctgtagtggataaaaaaattcacatccgtaggcaaagtccaagagcaactgttgaaaaaatgatctttgtagcgcaacggttggtccctcgatctctgaagcggttggcaatcttgtcgattgcgtgccgtcgacaccagccggctccagatccgagcggctgtttgcagtacctggtttttcgttcaggctcatggttcagtctccttgtacagctttcacccctatgcaatctgaatgtgctaaaatgatttgccgtgggagaaggtcagtttcagctgtaatccaacggggctggatgaatgcggctcgctctgcattagaggcagatattggtccgaacctgctcgcaaagtcgggacaatcccttgtttgccaaacactgtcgagagtggtcctcgccggtcgccgtcaggggccgcgtctaaacgataatctgcgatcccagttcaacaacccggttggcaggaaggtgaaaatagtctgatgggagtgaggccgcattcgcaaggaggatgtagaaccggtcctgccagtagggcatgcctgaattggcgtccggcaccagcttgcgccggccgagatagaatgaggtcgacatgatgtcgaacttcagtccggccttgcgcagcgtcgcgagcgcctgtgagacgttctgcgattccatgaagccgaacagcagttcgacgcgcgagaaacgctcggaaatctgctcgaccttgtaacggtcctgactcggcacacgcggcttgttgaccgtgcggatcgtcaggatgacgttgcggtcgtgcagcacgtgattgtgcttgagattgtgcagcagggcggcgggtgcggattccggatcgctggtcaggaagatcgccgtgccgggaacctgggccggcgaatgttcgctcttgcgctcgatcgagctgacgaaggaggcgagcggaatatcggtgtggcgggtcttttccatcaggatcgcagtgccgcggcgccaggtccacatgatgacggtaaaggccgtggcgatcaggatcgggatatagccgccgtcgtggatcttcaaaagattggcgccgaggaagatcaattcgagtatgaccagcggcgccagcgcgatcaccgcaaccggcagcgaccagttccaacgggcgcgaacgaattcgaaggccatgatcgaggtgacgaccatggcgccggtgacggagatgccataggcggtcgccagcgcgtccgaggttttgaaactcaggaccaggaagatgacgccgatgaacagcacggcattgaccgagggcacgaaaatctgcccggtattggtttccgaggtgaagaggatttccctgcgcggcaggaagccaaggttgatgccctggcgcaccatcgagaaagcgcctgttataacagcctggctggcgatgatcgtcgccgcggtcgccaggatgacaaccggcagcagcgcccattgcggatacatcaggtagaagggatccgacatcgtctccggcttgccgagcacgagtgcgccctgcccgagatagttcagcgtcagcgacgggaagaccagcaggaaccaggcccactggatcgggcgacggccgaaatggccgagatcggcataaagcgcctccgcacccgtcaccgtcaggaagacggcgccgagcacgacgacgccgtagaagccctcatgcagcaggaagctgacggcatagtaaggattgaaggcggcaagaatgccgaaatcgtccgagatatgcgaaatgccggcggcggccatgacgaggaaccagacggcggtgatcgggccgaagaatttggcgacggcgccggtgccgcgcgattgcacgacgaagagcagcgccaggatcaccaccgagatcggcacgatatattccgagagcctgggcgtgacgagcttcaggccttcgaccgccgacagcaccgacagcgccggcgtgatcatcgcgtcgccgaggaaaagcgcagcccccaagaggccgagcagcatcaggatggcggtatggccgttggcggtcttcatcaaaagagcaagcagcgacagcgtgccgccctcgccttcgttgtcggcgcgcagcaggaagagcacatatttgatggtgacgatgatcgtcagcgcccagatcatcagcgagatcaggctgatgacctcgaaacgggtgagcccgtcatgggccaccggcttcaacgcctcgcgaaaggcgtagagcgggctggtcccgatatcgccgtaaacgacgccgatggaacccagcgtcagatagaacagctttttcggcgtcatctgggattcggtcggatggctttctgcggacatgatttcaacaggctcttcggagccccagcctccttttcccgcatcgtttaaaacgcaacaaaggctttcgcaacggcgttggaaaattgaccggtcgaagaattctttgatgatgcaggcgtttctttgaggccttatctcatgatctcaacagagctgaaacgtcggatcgagcttcatctgtaacgctcacaaagttgcaaatccgttcggcaaactgatgcgctgatcgaggaccactcgggctcttaaagcgacgagtttcgcaggggcggctttcagaattgccgatcgcagacgcggcggcataccaagccgctttgaacgacttcaaatcgcgcgcttcgctgaggacgtcaaatttgatttcatttgtaacaggggaccacgcgtcgattgaaatccgaagcgcgttcaacataaaaacatcgggaagacttccttttgaaacgtttgggtcagcctgtcatgttcgtgcgttccgatgctctctcccgtataaagccttctgccactatcgttgtctcgcagaagtttcgcgagcttaaagctgagggcagggacgtggtccgcctcaatataggagagccggatttcgatacgcccgacaatatcaagacggccgccatcgacgcgatcaaccgcggcgaaacgaagtacacgccggtgtccggtatccccgagctgcgcaaggcgatcgcctccaagttcaagcgcgaaaacggtctggaatattcctgggagcagacgatcgttggcaccggcggcaagcagatcctgttcaacgccttcatggcgacgctgaacccgggcgatgaagtcgtcatcccggcgccttactgggtgtcttatcccgagatggtggcgctttgcggcggcacgccggttttcgtttcggccacccaggagcatgacttcaagcttcagccggcggatctcgaaaaggcgatcacgccgaagaccaagtggttcatcttcaactcgccgtccaacccgacgggtgcggcctatacgcatgcggagctgaaggcgctgaccaacgtgctgatgcagcatccccatgtctgggtgctgaccgacgacatgtacgagcacctgacctatagcgacttcaagttcgtcacgcccgttgaagtcgagcccagcctctacgaccggacgctgacgatgaacggcgtctccaaggcctatgcaatgaccggctggcgtcggctatgccgccggcccgctccagctcatcaaggccatggacatgatccaggggcagcagacctcgggtgcgacgtcgatcgcccagtgggcggctgtcgaagcgctgaacggcacccaggacttcatcccggcgaacaagaagatcttcgaaggccgccgcgacctcgtcgtctccatgctgaaccaggccaagggcatcgtctgcccggtgccggaaggcgccttctacgtctatccgtcctgcgccggcctgatcggcaagacggcgccgtcgggcaaggtcatcgagacggacgaggatttcgtttccgagcttctggaatcggaaggcgttgacgtcgttcacggctcggccttcggcctcggcgcgaacttccgcatctcctatgcgacgtcggaagcgcttatcgaggaagcctgccgccgcattcagcagttttgctcgaattgctcgtaagagcgtatcctccagaggttattttatgaatggtagagtttctcaaaaagtgtcggaagagtccgggccaatgatatcggcgtcgatcgacccagacaacgttagtatcgcggacttagatcggttcggccacgctatttttaaagaatggcggccgaagcggcccttcctccgcaggcaggacggcgtatacctcgtacttagggcggacgatgtattgggcttaagtagtgaccctcggacccgtcagatagagacggaactgatgctcaatcggggggtcaacgaaggagcggtcttcgacttcgttcgctacagcatgcttttttcaaacaaggaaacccacagcaggcgtcgctctccttttactcggactttcgcattccggatgattgaaaatctacgtccgcaaataaggcaattgacggagatcctttttcgagatttgaaggagcttggttccttcaatttcgtgggggaatatgcttcaaagctcccagccgttacgatagccagcctgttaggcctcccgccaagcgacattccctattttactcaactcgtctatcgcgttgctcgctgcctgagcccttcatggcgggatgccgactttccggacatcgaaaaatcagcggtcgagtttaagaactacgtgcaagcggtaattgacgatcgccgaacggatccgcgtgatgacttcctctcatcctacataaacgcaacgcgagaagcggaggatctctcgcccgtcgaaggcctaacccagctgatgcttatcatcttggctggaactgacacgaccaaaaccggcctcactgcactgaccggacagcttttgcaacatcgacaggcatgggacgcactgttgaacgatggtactctcgtggccgccgccgtcgaggagggactgcgctttgagcctccagtcggatcctatccccgttcaacactggcagatattgatcttgacgggttcatactacccaaaaatagtcttctcgcactttgcaccatgtccgcgctaagagacgagaaacactatgtccaccctcaacttttcgatattcatcgcaagcagatgcgctggcatatggtatttggcaccggtgaacatcgatgccttggggaagcgttggctcgtttggaattgcaagaaggacttgctacggtgcttagacatgctcccaatctctcgattgaaggtgaatggcaggcggtacagggtcatggaggtgtgcgccgaattgcggagatgagagttggcttcaatcgagaaaattgaagcgagttgctttctctcgttggctgatgggaagaaagcgcataggagtcgccgccaaattcttgtcggaccagcttggtttgttcggtcggtgtttttcaccgtggatgcggagtaatgagaaactgggtcagaccactgggctccgttgattccgcgaaatctgcttagttggattggctgtcagaaggagaggtgaccgcatgatttgggatcatttatcaccttcccgaagggttctgcttgatatcaaatcgtggtctgtattggtactggtaattgcctcgatatcttttgcggttctggccataggatcttggcaagacaacgaaagcaacgaagcgatcctgacagagctgcaatcgatcgacgtggattgcgcgatgctgcagcggaatgtgttgcgtgctcacgccggccttcttcggaattaccatcctcttatcgtccctctggggcgactgcgcacgagcgtcgcagatttacagcagctttttaggcgggcgggcctcgacggggccggtgaattttctgaattgctggcgcgggtgaagagctcagtagatgcgaccgacgcagccgttgcagcgttcggtacgcaaaatgtaatgttccaggattcgttggcgacctttaaccagtcgatagcttcgcttccgaggtctttggatacgagggatttgaactcgctagaagtcgctgagttgggctatctgatgctccagttttcgtctcagccaaatttcgagtttgcacgggaaatcaaccaacgtctcgaccggcttcaggtttcggcgaacggggataaggcaggcgtcaaggagatcgttcgcagtgggaggattatcctgactctactgccgcgattgaaagacaccgttggagtgatccaaacttctgaaaccatcgacaacacgaagaagttgcagcgagcataccttgaagcttatagcttggccagcgcgggtgaacagcgggtacgggtcttcctcggcgcagtttcggttttcttttgcttttgcataatttccctagtccataggttacatctgcgaaccaaggtgttgacgagacgactggacttcgaagaagtgatcaaaaagattgggctttgcttcgaagatgcttcagaagcaaaaccgtcgttggaatcctcaacgaatgccgcgttgggaattatccaattattctttgaagctcatcaatgcgcgctgggactggtcaacatcaatgagaatgacgttagcgtcaccttttttggaagcactcctgcgccagagtggaacgaacaacgggtgcgcgaaattgtttccacggtaggggccgaggacggcgggcggattttccgagcctatcctcaacgaaaagcgagctgcttcggtgaggactctccatttctgtgggtgctgcttgcgttcaaggtatccgatcgaatagtcgctgtctttggcctgggatttgatcgagagcatctacagacgccgaccgcacgtgaaatgcagctgatggaactagcggctgcatgtgttagccactatgcggtcattcggcgcaagcagtcccagcgagatattctggaacgtcgtttgaaacatgcggaacggcttgaagcagttggtacgcttgccggcggcattgcgcatgaatttaacaacattttgggtgcagttctgggttacgcggaaatggcacacaacgttctgcgccgtcgtactcatgctcgagactacatcgatcacatcatttctgaaggcaatcgagcgcggttgattgtcaaccagatccttgcccttagtcgaaagcgggatcgaacaacaaaaccattcgatctttcggagttagtgaccgtgatcgcgccgtcgttacgtgttgcgttgcctccgggcgtcgagctcgatttcaaatatcagagcgctccaatggttatcgaaggaaactcacttgaggtcgagcaaatactgatgaatttgtgcaaaaactctgctgaagcatgccgagagttagggcgtgtggaggtcagcgttaggaggtctgtcgtacggaaacacaaggttcttacaaacggtactattcccaccggcgagtatatccttctttcagttgaggataacggcgcaggcataacagaggcggtattatcgcacattttcgagcctttttttactacccgcgcccgcagcggtggcacgggcctgggattatccacggttcacggtcacgttagcgcgatggctggttacatcgacgtggtatcaactgtcggcagaggtacgcgcttcgacgtctacttgccaccttcgtcgaagcagccggtaaattcagagagtttttttgaccctggaagaatcccgcttgggaacggcgagattgtcgcggtggtcgaacccgacttagccacgctggaaatgtacgaggaaaagatcgcggcgctgggctatgagccagtcggctttaacacgttggatggtttaatcgactgggtgttggaaggaaaagaacctgatcttgttctaattgatcaaccgtctttgctggatggagacggtgcagggtccttaatctcaaagctggcaaaagcgcccatcatcattattggcgaaaaccagaaaaatgttcccctttctgcggatcgcgagggatctgcccgttttttggaaaagccgatttcagcaaagactctcgcctatgtcgttcgtgcgaatatcagaactgaacgaatggtcggctcgaatagcagcgaaatcgtgattgcgtcataaaccgatacgccctctgaacagaagccggccgcacaacgcgattgcttattaatttaatccccagtcgcggaatcagccggtcagtcccgacatccgcaacaacgcaactccggttgcggctgcaatcaccgccagtgatatacaggcaaaaaaccggtaaacctgctcttttgatgttaagaggagatggatcgaagcgatcatcagaaggaaaatcgtcgcaagtgcgccatacgcccaatactcgttcgaataaagccatgttcccaaagccaacagaccgcaaacaaaaaaaacgagttcgagcttttgcaagacaacacctcaaaaagatctcgttgtgatcctaggacatcggtctcgcaggtcaatactgcgatcgcgtttcatgcaacggacttgatgtatctgccgcgcggcactaggagacgtgaggaacggccccctgtctagggtgcagtcggtgccgatctccgcttcgggggcgctttgcgaaatctcctgcggctgcaccatcctccgcgccagcctgcgaaaattttcgaaaaccgccgctatggtgaattcgctctcatggcctagggatcaccgcttgggccgccgattccctcgattcaagaaatcaaacggcttcgcttcgatgcttcaaatgaaaccgagaggtaagataataaaatcagaaagtaacagacacctcccatagtcgcgactgttagcgatcgagtcatttcatgctgaccaagatcattgcgatacagtggggaataaacaatgcggaagacggcaggatctttcgggatcatttttctgatggtccagccaagcaaagctgcgccgctctcgttcgctgaatttaaccaactcgctcgcgaatgcgcaccttcagtcgctccatcgacgcttggagcgattgcgaaggttgaaagtcagtttgatccgctcgtgctgcatgacaataccaccggcgaaactttacatggcaagaatccggcggatgctacgcaaagcgtaaacaatcgcgtcgcagcagggcattcagtcgatgtaggcctaatgcaagtgaactcgaaaaatttcgcgaacttgggcttgactgccggcaatgcaatcaacccttgcgtgtccctgtcggcggcggcggacctgctcgtacggcattatagtggcggcgacacggtagagtcagaacaacttgccatccggcgagcaatttcggcttacaataccggcaacccgacacgcggcttcgcgaacggctatgtgcggagggtcgaagtggcggctcagctactcgtccccccgctggctcagtcggggaaaaaaggcgaccgtgatgagcggagtccagaagaaccctggaacgtctggggttcatacgaccgctcccactcagcagtcggttcgtccgcgccgccagaggcgcagcagccgaatgagcgcaaatcccccgaacaagatcaagttttcgaaccgaatgatggagatgcaccataatggcatggcttgaaggataccgcgcaccgtcgaaattccgtggcctctggcacagagctgtgcgcctgctggctccgcacgtgccgagcgtcaccggcgcgatcggctggagcttgtttttctgcgagccagctgccgcgcaggccgctgggggcactgaccccgccaccatggtcaacaatatctgcacgtttattctcggtccgtttggtcaatcgctcgccgttcttggtatcgtagccatcggggtatcgtggatgttcggccgagcttcccttggtctggtagcaggtgttgttggcgggatcgttatcatgtttggagccagctttctcggccaaacactgacagggggcgggggatgaatgccgatcttgaagaagccacactctacttggcggcaacgagacctgcattgttctttggggtaccgctgacgcttgctggagttttcatgatgttggcggggtttctcatcgttgttgtgcagaaccccctctatgaaattgttctcttgccgctgtggcttggagcgcggctcatcgtagagcgggactataacgcggcaagcgtggtcttgctgtttctccagacggcagggagaagcgttgacggccatgcgtggggcggcgcgagcgtcagtcccaaccccatcagagtggcgtcgcgaggaagaggaatgacgtaatgttcggagcaagcggacggaccgagagatctggggaaatctacctgccttacgtagggcacctcagcgaccatgtcgttcttctagaggacggttccatcttgaccatggcgcatatcagtggccttcccttcgaactggaggaagtagaggtccgaaatgcgcgctgccgtgcctttaacacgctctttcgcaatattgccgatgataacgtctcagtatatgcccatctcgtccgtcacaacgatgtgccagtaccgccggtacgccattttcgcagcaccttcgcgtcaagcctaagcgaaacgttcgagcggcgtgttctgtctggtaaactgtttcgaaacgaccacttcctcacgctcattgtctctcctcgcaccactctcggtaaagtgggaagcagattcaccaggcgctatgggaagaacccaggcgatcttgcgcatcagatccgacatctggaggatctttggaacgttgtcgctggcgcgcttgatgggtatggacttcgtcgacttggcatccgagaaaaaaatcaggtgcttttcacggaaattggtgaagcccttcgcctgataatgacttgtcgttttttaccggtgccggtcgttagcggatccctcggcgcctcagtttataccgaccgggtcatctgcggcaagcgtgccctcgagattagagcgccgaaagatcgttacgttggatctatcttttcattccgcgagtacccggcaaagacgcggcccggaatgcttaacacactcctgtcatcaagttttccgctcgttttgagccagagtttctctttcctcacacgtgcacaggctcacgccaagctcagcctcaaatcgaaccagatgactagctccggtgacaaggcggtcacccagatcggtgaactcgcccaagcagaagattcattggccagtagcgaattcgtcatgggttcgcatcatctcagcctttgtgtctatggcgatgatctcgatacccttgccgactatggtgcgcgagcccgcacgagcttgtcggacgcgggcgcggttatcgtgcaggaaagcattggaatggaggctgcatactggtctcagcttccaggaaaccacagatggcgtacccgtcccggagcgatcacttcacgcaactttgccggcttggtttcattcgagaacttccctatcggaaggaagtcgggccattggggaggtgcggttgctcgtttccgtacaaacggcgggacgcccttcgattatattccgcacgaaaacgacgtgggcatgaccgcgatcttcgggccgattggcaggggaaaaacgacacttatgaccttcatcctggcgatgcttgagcagagcgtggttgaccgcagcgggacgatcgtttttttcgataaggatcgtggcggtgaactgcttgtgcgcgccaccgggggcacgtacctcacgttacgacgaggtgtcccaagcggccttgcacctttgcgcggcctagaggatacggcagcggcgcgggactttctccgcgagtggatcgtggcgctgattgaaagcgacggcagggggggaatttcgccggaggaaaatcgccgcttagagcgcggtatccaacggcaactttcgtttgagcctaacatgagatcccttgcgggcttaagggagttcttattgcacgggccctccgaaggtgcgggagctagattgcagcggtggtgccgaggcaacgctcttggctgggcgtttgacggcgaatcggacgaagtgaagttagatccttcgattacgggcttcgatatgacccatctcctcgaatatgaggaggtatgcgcgccggccgcagcataccttttgcatcgaataggagcgatggtagatggccgacgcttcgtcatgagctgcgatgagtttcgttcctacctgcttaatcagaaattcgcagcagtcgtcgacaagttcctgctgaccgtccggaagaacaacggaatgttagttcttgcgacgcagcaacccgagcacgtacttgattcaccattgggcgcaagcctcgtagcacaatgtatgaccaaaatcttctacccatcacccactgcagaccgctctgcttacatagacgggttgaagtgcaccgagcgagaatttcaggctattcgcgaggagatggcgattggcagccgcaaatttctgctgaagcgcgagagcggaagtgttgtgtgcgaattcgatctgcgcgacatgccggaatacgtcgccgtactatccgggcgtgccaatacggtgcgttttgcccagcagttgcgcgagacgcatggagaggaaccctctgcctggctggaaaaattcatgacgcgctaccatgaggcacaggattgatctggagttcgaagtcatgaatattacgaagctcgtaataaacgcacttttcatatgccttgttctgtcggggactgccaaggcgcagtttgttgtcagcgaccctgcaacggaggccgaaacgctgacgacagcgatcaatactgcggcgaacctcgagcaattgatcacgatggtgacaatgttgacctcgccctttggcgtcaccggcatgttatcagcgatcgaccagaaaaaccaatatccctctgccggccaactcgacaaggaaatgttttcgccgcagatgcctgcttcgacaactgcgcgtgcaattaccttagatgccgatcgcgcagtcgtgggcgacgacgctgaaggaaatcttttgcgacagcagattgcaggcgccgcaaatgctgccggtgtcgcggctgacaatctggatgcaatggacaagcgccttgcggcaaattctgagacatcgggccagctctcccgctcacgcaatatcatgcaggccaccgtcaccaacggtttgcttctcaaacagatccatgacgcaattattcaaaacattcaggcgaccagcctgttgacgatgaccaccgcacaggcggggctgcacgaggcggaggaggcggcgacccaacgaaaggaacatcaggcaactgcgcttatatttggcgccgctcaactgcactgatccgctactgttcattcagggccctctttctccgtagaaaatcgaagctaaatccaggtaagggcaatgaattttagcattcctgcgccttttacggcgatacatacgatattcgacctcgccttcaccgtcgggctggacacgttgcttggggacattcaacgggcagtcagcgctcctctcgtggcctgcgtgacgctatggatcattgtccagggcatcctcgtaatgcgtggggaaatggacgcacggggcggaatcacccgggtaatcatggtatcggtagttgttgctcttatcgttgagcaggcggaatatcatgattacgttgtctcggttttcgaggatacgattccgaatttcattcaacagttcggtatcagtgggcttcctttgcagacgattcctgctcagctcgacacgatgttttcactcacgcaagtagcctttcagaagattgcttctgaaattgggccgatgaacgatcaagacatcctcgcctttcaaggcgcacaatggattttctatggaacgctttggactgcgtttggaatctacgatgccgtcggaatcctcaccaaggtgctattggcgatcggtccattgatgctcgttggctatctcttcgatcgcactagagacatggccgcgaaatggatcggccagctcgtcacttatggcatacttctgcttcttctaaacatagtggcaactatcgtggttctgacggaagcgacggcactcgtgctaatgctcggggttatcacttctgctggcacaacggcggccaagataataggcctctatgaactcgacatgttctttctgaccggcgacgccttgatcgtcgctcttccggcaatcgccgggaatattggagggagctattggagcggtgcgacgcaaacggccggtagcttaaatcgccatttcgcccggacaatccgccgttagtcccagcttcacaaatggaggatttccttgaagtactttctattgtttttgatcatcggcttggcgtcttgtcagacaagcgatcagttggcgacttgtaaggggcctatttttccgctgaacgtcgggcgatggcagcctgctcagtcggaccttcagcctaccaacgcaggagaggctaatgaacggctctgaatacgcgctgttagtagagcgggaagcattggcggaccactataaggaagtagaagcatttcagtctgcacgtgctagatcagctcggcgaatctctagagccttggctgctttggctgtcattgcagtcgcaggaaacgtggcgcaggccttcgctatcgccgtcatgcttccgctgaacaaacttgttccagtatatctgtgggtgcgcccagacggtacagttgacagtgaggtatctatttcgcggttgccggcgacgcaggagcaagcggtcgtgaatgcgtctctatgggagtatgttcgtctgcgggagagctactcggcggatacagcccaatacgcctatgatctggtctcgagcttcagtgccccaacggtgcgtcaagattatcagcagttcttcaattaccccagtcctagctccccccaaaccatcattggtaagcgcggaaagctggaagccgagcacatcggctcaaacgaacttatgactggcgtccagcagatccgctacaaacgcactctcatcatggaagggcaagctccaatagtaaccacctggaccgcaacggtacattatgaaacggtaactaacttgcccggccgattgaggctgacaaatccaggcggcttaatcgttacctcctatcaaacttcggaagataccgtttcgaacacgacgcggagccagcaatgatcaagaatttgtttctgggcctggtttgtatcctctttgtaaccagcggcgcgaacgcggaagacacgccagcggcaggcaaactggatccacgtatgcgctatctcgcctacaatcccgatgaggttgtgcacctttcaaccgctgttggagccacattggtcgtaacatttgggtccaatgaagcggtgacagccgtcgccgtttccaacagcaaagatctcgctgcgctcccacgcggcaattatctgtttttcaaggccagcaaagtgctgcagccgcagcctgtgatcgtccttaccgcaagcgacgcaggaatgcggcgctatgttttcagcctcgcgaccagaacgatgtctcggctcgataaagagcagcctgacctctactacagcgtacagttcacttatcctgccgacgttgccgctgctcgccgaaaagaagcggagcagagagatcttgcggatcggatgcgggcgcaagcacaatatcagcgtcgagccgaggacttgctcgagcgtccgccagcaggtggcagcacagatgcgaaaaattggagctatgtcgcgcaaggagaccgctcgctattaccgctcgaggttttcgacaacgggtattccacgacatttcgctttcccggaaacgtgcgtgtaccttcaatctacgtgattaacccagatggcaaggaagccacggccaactattcagttaagggagattacgttgaagtagcatcagtttccagggaatggcgtctgcgggacggccatacagtactttgcatctggaataaggcatatgacgccgtcggacggaagccgggcactggcacagtcagacccgatgtagtgcgcgtgctgaaggagacgaggtgatggaggacgtgaatgcccaatccagagaaggtatcgacgcgcccggatccctcgtcaccgatcctcatggccggcgcctctcggggtcgcaaaagctccttgttgcgggtttagtcctggtactgtcgttgagcctcatttggctcggggcgcgttcaaagaaaaggaccgagccgtctccaccaaacacaatgatcgatgccaacacgaagccctttcggccggccccgattgatattcccgccaaaccggcaatgacaccgccagctgcggaagcaacggttttgccgtcggatcaacatcagcgagaacacaacgaactgaggcccgaagaaacaccgatctttgcctacagcggaggtgatcagaatggtgtcaaatccgccccacacgctgatattcagaacggtggccaagacaatagaaacgccaactccctagccgcgtcggaggattctgctgagaacgatctctctgtgcgcttgaaaccgacagtgttgcagcctagcctcgctatacttttgccgcacccagatttcactgttacgcaaggaacgatcattccctgcatactgcaaaccgccattgatacaaatctggcagggtatgtgaaatgtgtacttcctcaagacatacgcggagcaaccggaaatgttgtgcttctggatcgcggaacgacagttgtcggcgaaatccagcgtggactgcagcagggagacgcccgcgttttcgttctctggaatcgcgcggagacgccctcacacgccgtcgtctctctttcctccccgggggccgacgaactcggccgttccggactgccgggtacggtcgacaatcatttctggaaacgctttagcggggccatgctcctgagtgtcgtccagggcgcagtccaggcggcaagtagctacgcagggaattcgaccggcgggaccagcttcaatagtttccaaaacaatggcgaacaagcggccgatacggccctaagggcggccataaacattcccccaaccttgaaaaaaaatcagggtgacacggtctcgatcttcgtcgcgcgggatttggatttctcaggaatctaccagcttcatatgactggtggatcggtgaaacgtcggcatctgcgctaatgcacagatagccaaagctgcgagatgcatccaatggaagtaaatccgcaattgcgcgcccttcttaacccagtcttgcaatggctcgatgacccgaggactgaagaagttgccataaacggaccgggagaagcctttgtacgccaaagtggcgtcttcacgaggttcgccgcaccgttctcttatgatgatctcgaagacatcgccattctagcaggggcattgcgaaaacaagatgtcggcccccgcaaccctctttgcgctaccgagctcccaggtggcgagcggatgcaaatctgcttgccgccaacggtaccctctggcaccgtgagcttgacaattcgacgaccgagcaatcgtgtctctgaattgggggaagtctcggctcgctacgatgttcgtcgatggaatcagtggcaaatccggacgcagcgacgagatcaactagacgaagcgattctgcgcgactacgacaatggcgatctggaatcatttttacgtgcatgtgttatcggtaagcggacgatgttgctttgtgggccgaccggaagcggcaagaccacgatgagcaagaccttgatcagtgctattccgcgggaagaaaggctgataaccattgaagatacgctcgaactcgtcattccacatgagaaccacgtcagactgctctactccaagagtggggcagggctaggtgcagtgactgcggaacagctgctccaggcaagccttcggatgcggcctgaccgaatattgctcggtgagatgcgcgacgacgcggcgtgggcgtacctgagtgaggtggtctcaggccaccccggatcgatttcaaccatacatggggcgaatcccgtccaaggcttcaaaaagctgttctcacttgtgaagagcagtgtgcagggggcatgcttggaagatcgcacactgattgacatgttggcaacggcaatcgatgtcattgttcccttccgtgcttacggcgatgtttacgaagtgggcgaagtatggctcgccgccgatgcccgccgacgcggtgagacgataggggatcttctaaaccagcaatagagccgcacggaggtctgctcgcgcagattttaaagcgttacaagtgtagcgcgctgcagcaactcctgtcatcaatctgaaaccttccgttagcatttttgtcatgcacggcttggccgaaattttgccgaactaccctcatagtgagagaaaatgatcaggttgaggctgagacgtacatcctctgcttgcacgaatctatcgattctgcagaatcccatacggaggcgaactggtgaaacatgttcttgtcatcgatgacgatgccgcgatgcgccatcttattaccgagtatttaacgattcatgccttaagggtcaccgcggtatcagatagccagcaattcaaccgggtacttgcatcagagacggtcgatgtcgtcgtcgtggatctcaatttagggcgtgaagacggacttgagatcgttcgcagtctcgccacaaaatccgatgttccaattataatcatcagcggtgatcgccttgaggaggcggataaagtggtggcgctcgagctgggagcaacggattttatcgcgaaacctttcggaacgcgcgagttcctagcacgcatccgtgtcgcattacgcgtgcgaccgaatgtcatgcgaaccaaagaccggcgttcattttgtttcgccggctggacacttagtctcagacagcggcgattggtatccgcacaaaatggcgaggtgaagcttacggcaggggaattcaatctgctcgtcgctttcctggaaaagccacgcgacgtgctttcccgagaacagctcctcatcgcgagccgagtgcgtgaggaggaagtatatgacagaagcattgatgttctcattttgaggctccgccgaaagcttgagcaggatgcagcgagcccaaacttgatcaaaactgccaggggtgccggctatttcttcgacgctgatgtggatgtttcctatggaggtctgatggcggcctgaagcagcgacgcatatgcctttttcgatctgatcctaggacgcggactcgttaattgaagcgatccagattctcgtcgcggcaagtttgagcccggcaaggtagttgtcagcacgtctgtcgtatcgtgttgccagaccacgcatctgtttgatggttgaagaaacgctcgatcagattgcgctggcgatagacccaacggctgaaactgaaggtctgttttcggttggccttggcggggatgtttgcccagcatttgcgttgcttggcgaagttacggatcgcgtcggtgtcataggccttgtcggcaagcagtgtcgttccgggccgaatgtcactcagcagcttttcggccataggagcatcggcggcctgaccggcggtcaatgccagtcgaaccggcaaaccatcagcatcgacgagcgcgtggatctttgtcgtcaggccgccacgcgaacgtcccatgcaaggatcggcagatccccctttttttcgtttgcaccatgctggtgaacgcggacgcaggaagaatcgatcatgacgatctctccggcataatgccttgaaacagcgccgggaaggcgatcccagacgcctgccttgcgccagcgagagaagcgattgtagagcgtcgtgcgcggaccatagcgctccggtacatcacgccaggatgaacctgtccggaaacgccataggataccattgatcacccggcggtcatccacgcgctcaactccacggctgttggtcggcagcaaaggggcgataaccgcccattcctcgtcggtcagttcgtgacggcgcataacaatctcctttccaggaaattgaatcacacaacgtcatcaacatgaaccccgttatggggacacagcctagagtgagctggctgtgttgtagctgggtaggggctgcctcattgcctgctgtcgaatacaataccgccgtcaagtgaccggcctcatcatattagcgttcttttcttatcttctcttcggcaaagaaagatgcaagtgcggccgtagccagtttgtggccaaaagccctggcggtctccaatctcaatggatcaaagtgattgcgtgcgacttctaacagcgataccgggaacatgcgagaagtcaggacaacgataggtttttcgactacttttgagatcgggtagctttgaggccccgtgctaaatgatccgtccgccaacatgttctcaaaatcggcgagcgcacggcgcaagatcatctgcagcgccttggtagcgctgtactgcagaatcaagttgtcatatatcttcgatacctcaggagcgggggggcgtgccgaaagaaagacctggactttttccggcggcgcagtcgaactcaaggcgtccgccgttagcattgattgccgatcgaagttgtcacgacgtttggcggcgataggaggcgctggtcgtttttcctttccggctctttcaggtaattgcgaaggcgccaagttttgcgaggaaagagctgggattgggtgaacgatcggtcgcgcggcagcaagccgtcttgcttcaccgacagacaaagcaggtttgcggatccccatcttcaattccccaaggtatcgccaatcaattctgaaattgttacgagttcctccatcgcaattctgaggttccgctcaaggaggcgcatcgtcggatcatttgtcgtgttcagcaatgtgagatgcaacatgccacgctctttcattgcagcgaacgcgtctcgttcatgcattggagattgtacgacaggcagattcaccagcatgtctgacatcgcgcgttgtgacgtggttaatcggccaaccggaactcgctggcgtaacacggcggtcggaatcactaagttctcgctcagcagcagctcgacaacataacgatatgtcgaaagtgcctcatcgatatccagcggcgttaacattgtcgggatcagaagcaggtttgagctagcgatgattgtgttattgagctcgctcgaaccaccatgcgtatcggccagcgcataatcaaattcctgaagctcggcgtcctcataagccgcttcaagaagcgacatttcttctgcagcgtacacctcgcaggatgtatcccaggtgttgctacgcatcgcgttttctttccatcgcgttaacggccggttctcgtccgcatcgaagagagccactcttttgccgtctcttgcaaacgcagcgcaaaggcccatgagcgccgtggttttgccggcgcctcctttaaatgagcaaaatgtcagaagtttcataagtttatcctggcgacgttgtgaacgaaagtgcgtctgtatcattgtttgtatgtgtgactgtctgtatagcgaaattatcaggagtatatttcaattgcattgaaggatagttgcaaatgtaactatatagatccgaatatgaacagtatattcttgaatttattctgttggcggctaggctccctcagtctcaactggagaatttcactccggaacaaatccagatcattccgttttctatggagcaagccatgtcgcaaagcgaaaaatccacttcaagtgacattgtcgaccggcgtgaaggcccgaagattgaaggtttcaaggtcgttagcactcgtttgcgatcgtcggaatatgagagcttctctcgccaagcccgtctgctggggctctccgacagcatggccataagagttgcggttcgccgcattgccggctttctcgaaatcgatgcagagactcgtcagatgatggaagccattcttcattcaataggagcactctcaaacaacattgccgcgctgctgtgtgcctatgctgaaaatccgacaacggatttgggcgctctgcaagctgaacgaaacgctttcggtaaatcgttcgctgatctcgacggtttgctccgttccattttgtccgtatcacggcgacggatcgacggttgctccatgctggcggacgccttgcagcattaacgtagcacttgggggaatctgttggatgcccgatcggtctcaagtcatcatccgcattgtgccgggaggtgggacgaagaccctccaacagattatcaaccagttggagtatctatctcggaagggcaagttggagctgcagcgttcggcccgacatctcgatactttcgtaccaccggatgaaatccgcgaactcgccctaagctgggttcaagaaaccgggacttatcacgaaagtcggccagacgaggaaaggcaacaggagttgacgacccacattattgtaagcttccctgccggtacaagtcaggtagcagcttatgcagcgagccgggagtgggcagccgagatgtttgggtcaggcgcagggggaggccgatacaactatcttacagcctttcacatcgatcgcgatcacccacatctgcatgtggtcgttaatcgtcgcgaacttttggggcacggctggctgaaaatatcccggcgccacccccaactgaattatgacgccttgcgcattacaatggccgagatttcacttcgtcatggcgtcgtcctcgaggcgacgagccgagctgagcgcggcatctcggagcggccgatgacttttgcccagtatcgacgcctggagcggcagcaggccaatcaaattcgtttcgaggatattgatttcgaagaattctcgcctgggggaaacgacggagaaccggatcaatcttttaattcttcgtacggttcgctgcctcaaaacgtgtcagaaaacttgcgacgaaacggcggtctgcaatcggtgtctgaagtacgttcccgggcactgatcggatcgaacggcaacggtgtcacgcccgatcgtgtatcatctggaaacgattcccgttctcaatccggcagcgataaagcctttgtggacgatggcaacttgaggaacggccctctcaccatcgccggagacggccaggatcttgaaggccgttctggcatgcatcgtttggcaaccgaacccgtcacgcacacaacaagcgaagatgatgttcggcaacggcctcatcgaaaacggcctcgcggtgatgaggaagagcagagcggcgcaaaactgaccagggtagacggaattcggacgggagtgacaatcagcgccgtaccggttgcccaggacgatccgattacatcgccgatccagccccctggatcaaatccgttggatgacccggggcagaccaacatcgctacggacgcattgcctccgacagccgatcgccggcagcagggagagccaaattctaagcgtcctcgtgatgatgacgccgagccgagcattcgtaagcggtcaagggacgggcgcagccaaggggatgagggaaacagaaggtagaaaaggatcgatcatggcagatgaagaatttcgtcgagacttcagccgctccgctacgttgaactcgaataacgaaggcgctacaggcgcaccaatcccggatacatcggtgtcgactgccttccgacaaaaccgcagagaacacttaacgaccagttccttacggccattaattactggtggggccggcgaccttccaggcacttcccccgaaaatcaacggccgacaacccatgccccgaatacagcagaaatactcccggtgagatcagccgaagctccggctggccaatcagcggtctttccgaggagcaaggggtattttcgtacggccatgcaatacctgcgggagattgaaatgcagtccactgccagggcggaccacgaggcgacgtcgtcgtcacgttttggcaagggggaaagaaagcagctgcgcgaacacgagcaaaccggtgatcaaagtgaatcaatggcgaagcggagtaccagctcgggaatgcaggtgggaactattgccgcgtctttggctatgaaagatagctcgaccgcgacgccggcttcgcaagggccgcaccggtctgggatggagctggataatatcgaagggactggagagagccgtacgcaatctcagcacgaaattgcgacacaacctattgccacaagcgcttttggttcaggtcatgatgtgatcattcctggagagggccagcctgaagaaacattcgacggcgcaccatattggatggtagaaagcggggatagcgagaccaatagccttccgtcgatccaacaaggcttatcttggccagggttagatgaccttgatttgctcgccgacagcagttcaccgctcagtactcaggttgttcctcctgacgtagccgctacgaatttaagcactgaggcagggtccgccagcgtcgaaagcacccaaatcctcgccgacagtgcctattccgacgacgcgaccgaaaccggtggccaaacagcttcaggatcgatccatgaaggctcagttcgttcgcttggctcaccggaggaacgcttcgacgcctttcccgagttgaccgacgaggacttggcgcagattgacgcattctcgcgagcccgctctccttcgaggcgagatgctgcgcacgctattcatgcggtcagcttggatgatgccttctcacgcaaggatcttgccgcgggccacgacggccggcttacgaatcctgcgttccgtcaggaggcttctctgcaggaatcgagcccatcagaaacgaagtccgacgacttcccggaattaaccgacgaggacctggcacggatcgacgcactctccgaagcccgctcaacttcgaggctggatgttgcacgcactattcatgcggtcaggttggaggcctctcggcaggacccgagcccatcagaaatgaagtccgacgacttccccgaattgaccaaagaggacttagcccggatcgacgcactctctggaccccgcccgactacggggcgggaaggtgcgaacactattcagccagtcaggttggacgatgctttctcagccgaagattataccgtgggccgcggcggccggcatacgaatcctgcgttccatgaggaagcttctcggcaggacccgagcccatcagagatgaagttcgatggcttgccggagttgaccgacgaggatctggtaaggattgacgcaatctctgaaccgcgctcgaagagatctcgctccgagcaggttgtcgggggaaaatctcataggctcaaactgaacgaggctatcgaggaggcgggctcgcccactaccgtttcgggaacaagcgccgccagggcggcacctatcacgctcgaaagcggagtacctaggttgccgcaggctacccatacggaacttcctggctcggacgttgcgggtccactgcggatcgggaaggcgtcgtgtgccgatatacggcgagatgtttcggataaagggaaacgaaaagtctcgtcagattatcagattcagcaaggtcctggcgcgtcctatgcttaccagccgcgacgcatgccgacggaagcgattttcgatgctgaacggcttggtgacgaagtgctcatcgggaatgagccagttccgcggtggccttacccctgggagcacgttgttcgttttgaaacaggcaagcagctcttcgaaagattgcagaagtggccgactgcggaggagttggaaaacagtgtgatcctcgtcaaagcggatagcgcgcaacgatcctatatgccccgaaatcagctgctcttgcatctcggatccgaaaagtattacgaacgaatgaaagcgctcggtctatccgataataccttcagcggattgaagtccgatagcaaatatttttatgatacacctgctggaccacgggtaagtgaacatgattatgagttcccgcggcaggcaggcgtgcataatccagaggtgatggttcagcatcatagcggaaccttcttcgcgttttggccaaaacttctcaggctggaaaagcttgcgacagtaacgaatacgtatggcgcggaaaatgtttggctcaaatcgccagccaatgcttacatgacgccggaaacctataattccaaggttgcgaacggcgccgaaaaccttttcatcgagttcctacgtcccgctcctgtccacgaccacctgcgggaacctggaacttcaaacgcaaaaactgttgacggacgaaacgaagatcgcgcgcaacaggccgaccggttagcagatcagtcgatgggccggaacggggacggccgtgacgcgcagggtggtaagagaaccttggaaccgcgcgtgcgcgaaaggtatgggctgtagatccagctgcccgtaaagcaaacagccgtccaataggataaacggagcgtggtcacgtgatgaattcaggcaagtacacgccaataggcctggctgcgagcatagcatgttcattggccgtggggttttgtgcggccagtctctatgtcacatttcgccatggctttacgggcgaaacgatgatgactttcaacgtttttgcgttcctgtacgagacaccgccttatttgggatacgcaagtcctacgttctatcgcggactagccatcatcgttgcgacgtcaacgctcgtgttgctatgccaactactgttatcgatgcgcgagcgcgaacatcacggcactgctcgctgggccggctccggcgagatgcggcacgccaggtacctccggcgctacagtcacgtcacgggtcccatcttcggcaagacatgtggaccacgttggtttggcagctacctaagtaacggagaacaacctcacagccttgttgtcgcgccaactcgcgctggtaagggtgtcggcgtcgttatcccgacgttgctaaccttcaagggctcagtaattgccttggatgtgaaaggcgagctatttgaactcacatcgagggcgcgtaaatcaagtggcgacgcggttttcaagttctcgcccttagatccagagcggcgaacgcattgttacaatcccgtgctggatattgccgcgttgccgcccgaacggcgctttacagaaacgcgccgcctcgctgcgaatctcatcacagccaaaggcaagggagccgaaggtttcatcgacggggcacgggatcttttcgtagcaggcatattgagttgcattgagcgcggcacaccaacgatcggtgccgtttacgatctgtttgctcagccgggtgaaaagtacaaactatttgcgcaactcgcggaggaaacacaaaacaaagaggctcagcgtatcttcgacaatatggcggggaatgacaccaaaatcctgacatcctacacatcggtgctcggcgacggcggactcaatctttgggccgatccactcgttaaagcggctacaagcacctcggatttttccgtctacgatctgcggcggaagaggacttgtatttatctttgtgtcagcccgaacgatctcgaagtcatagcgcccttgatgcgtcttctcttccagcaggttgtatcaatcctgcagcgatcgctgccacttggagatgaacggcacgaagttctgtttctcctcgatgagttcaagcacttgggcaagctggaagctgtggagacggcaattacgacgatcgccggctacaagggccgcttcatgtttattattcagagtctttcggctttgacaggaacttatgatgaagctggtaagcaaaattttctcagcaatacgggtgtgcaggtattcatggcgactgctgatgacgagacgcccaactacatttccaaagctatcggcgactacacattccaggctcgctcaacgtcgtacagccaagcgcgcatgtttgatcataacatccaaatctccgaccaaggagcaccgcttttgcgcgccgaacaagtccgcctactcgacgacgattatgaaatagtccttatcaaaggccaacctcccctcaaactgagaaaagtgcgatattattcggatttcatattgaagcgaattttcgaaagccaacacggttcccttcccgagcccgcatctttgatgttgccgggagacacaaacctcgttgaaggcaagctcgaccagggaacagccgatacaacttcgcaaaaaccggtgcagattgaagagaacgaccatggggaagtcgtttccccccaaaacagaactgtggctgatggagtaatgccaatagaagttcgcccccgttcaaacgaagttgatgacgagcgggaataccaaggcgcggacgccgcaacctctgagaagcttccggaaattgctccggctcttttggcgcagcgcgaactcctcgaccagatcatttcgctccagctacgaggtagaacagcctccggcacttgaagctcgatgtgataccgcttcggatcgagtcttgttagcgccgtcagatgtcccgtttcgggaatgcattaccaacgttgaaggttgccaattgatgagacatcgccatgaaaccgtcgggaagctcaaaaactggatacgccgggtcggctagatcctcgccccaggttcgcgcaggggttacgcctgtccttcatcccaaagagccttggaaccgttttgcttgctccccatctgacggccaaatggatcaccgggaaaatttatctgcgcaattcgcttacgatggaatgagactgggcgcagccgagcggtccgcgtacgagacatgggatagagcggaccggccgagttggaaagacctgatactgagcgctcgcctgaacgcgattgacagtttcgcttggaatgtcgatgtcggagaaagtacctcttcaacttttgtttatgatggtgttcctctggcggaaggggaacggcatgcctacgaggaatgggtggagccgggacagcccagttggcaacaactcgttgtgaacgcgcgtattgaagagctaaacacctctgctgcaattccgaatgagtgtagtccccttcaagaggaattccgatcggaggcgcctaagcgtaagcggacaagctccattggtcaaaagaacggtttccctgaaccattcgaatttgatgggatgagactcggctcgcctgagcgcgaagcatatgagaattggagtaaaccgcaaccgccatcctggaaagacctgatagttgacgcccgtcttgacgcaatcgacacctccacctggctcaacgaatcaaatgacacctcggtcttcgagtacgaaggcgtcccgcttggggagggggaacgcctagcatatgaaaaatggctcaagcccgcgcaaccaggatgggaagacctggttgtggacgcacgcgttgcggaattgcaccagtctgctccgacgtggtgcgaacaccaaccaggcaacgacgtttcttccaacgagtccgggcgcatctcgggcgtcccaattaacgccgagcaggtgtcgcgtgcgttcttcgtgtacgatggagtggcgctcggagcagccgagcgcgctgcgcatgatcgttggagcaggccggaccggcccacctgggaagatcttatcatagtcgcgcgccaagctgctatcgaaggcggtgccgtttcgaatgggatgatcgggaagacatcttcctcagtctttttatacgagggaatgttgcttggggatgcggagcgtcaggcgtacggacggtggaggcagctagcccagccgcggtggcaaaatctggtggtgaacgcgcgcctggcagagctcgacccggcggcctggattcccgatgaacatgatccgtctgaggatggcggggcgactggtcttctgtcgcaagcaagcacgaccaataagtcccgcctcagtttaggtgatcaaccggaagcgcgctcgcctagtctcgcacgtgagccagcacaacagccgactcacgtgcaaaacctgacgtgcgcacaattggaagcaagacgtgctctatatttcgggccctctgggagggatgcagaccaaaccgccagcatcgccgacagtaatcgcctcgacgaggtaagcaaagttaaacggctgggtgccaagagccgtcgaggcgctaaagcaacggcctatgacgtaatttcaagtgcggaaagactgtcgtctcacgagggttgtttgacggttcagtccactcagccagaaaaagccgcttgctcgagaagcgacaatatcggcacttatggaagtcgaaaaaacgaacgagctcggcttgcgaccgagaccgggaaatacgagtcggagcatattttcgggttcaaggttgtccacgataccctgcgctcgaccaaagagggccggcggctggaaaggcctatgcccgcctatctcgaatgcaaggaacttcatcgacaacatgttggtacgggaagggggcggacccgactggtggggcgcggctggccagatgacgcaagttaccgctcggatcaaagggcaactctatcggaccctgttgcgtccacggaaggtgcaacggcgtcaaacgggtatcaattaaaccagctaggctacgcacaccagctcgctaacgacgggctgcagagcgaaacgccagatggggttatcatgccgcttcaggtcgcgactactagctacaactatacggtaagccgcgatccggtactttctccgcccagtaaagagcaagctccggaattgttgcaccttgggccacgtggccagacagaagctgtactcgctcgcgaaacagcattgacaggaagatggccaacacgcgagcgtgagcagcaagtctatcgagagtttttagccctttatgacgtcaagaaggacctggaggccaagacacttgggttgcggaagaaaaaagctgcgcttgtttccgcgttgaaccggactgccgcctcaataggcacttcacccttgaaagcccaatcgtcgagcgcagaagttgaaaaagcaactcacgagtttgatgaacgacgggtttatgatccgcgcgatcgcggtcgggacaaagcattacaacggtgacaaagctggagatgaccatcgttagcggactttgtatcgatgcttaaaaatgatggttcagcatttgaaccgcaggctgtactgctactctttgaaatcccccgcaaaaaacgcgccgtagtgcaatcgatcgccagggcctgaatttcagttgaaacacgatgtccattcaacgccttaagcgcaggtgttagacttcgcatatccttgatccgcgttggagtgtgagttatgctcgaagacggccagaaaatgcaggaacgcgagctttcggtcctcggtggtgataagaccgaaagtgcagccaccttaccgaatgacattttggtggaagttgccaaacatctgccgaccgacgatccagtcgaaacggcagccaacctcacaagctttaaacttgcgagcccgtcggttcgggcatcggtcgatcagagcgatgtcggaacgttccaccgaagcgtaaatcgactgggtgcctcaagcaaggcattgtatgacctggctgtaccccggaacggctttgccgagtatccgaactatccggaaccggaccctgctggcgagtttgcgctggcgagccagcgcatcaggacaattggtccaactttgaagttccaatcgcccgccaggaaaacagcgatcgtcaatcacattctcaatatgtcggaaggcggtgagcaggcggaggcgattatgtcgatgacgtcccatttgagtgacctcgagagggccgacaagagacgccttatcgacagagcaattgaatacttcaaggtagacgggcctatcaactacgacagtcgccattatgcagcctacgcgattgcagcggcgcacaaccagttggaactcgaacacaagtcacaaatcttcgatgcaatggcgaagagaccccagcttgcgagactctacgccgacgaacgcatccatgcgcaggagcatttggggcttgcgtcgacatccgaaggtccgcacgagcggagcaataaacaactggccacggacattcttcagatcgaacaaaaaatccgcactgagctccttcccgaaactctcagtgctcacgaccagatggtaaaagcggaaggaatcgctggatcgattgagaaggcttaccgcgatgctcgcgcgaacttaacccgggcaccgcgagggaggtcaaattctgatctcagccggtagaacttggtctgaatattcgattatttctccgacgaaagcacttggttgacgagcgaatttttaaacgagcatcgataaagcgtgcacagggaaggcccacctaatggtcagtataaataaaaaagccccgcagaaatcttctacagcgaccacgcgcaattctgatgaacgcctggttgatcagttagggcaggcgtaccttgtggaacgcgaggcgcaggaaaggcgcgcgcgacttgaagcgccgccggcgttgaaaaaatatgcctcgaaactgcaactcctcaataagctcgatgcagatttccgtggtgtgatcgcccacaagccgtttcgcagcgagcaactgcgggtcgatagcaatggagaattgacccatagtcggggtctcataaaaaagaagaagaaggttttcattcgagatcaaacaactggctcccttcggcttattcactacgagaggtctgactggaatagtgtccgtcgctatgactacgaccagaacggcgtgttgagcgagaaacatatcaaaagcaaagccggtgccttcgaagaaaaatgggagcgggacgaaaacggtgaactgatgcgcacccgatacatcgatcggcgcagacttactggacgggcgttgcatcccatttccgaggaaatcggacgtccttatgagagtggcctggagaagaggctttatcgcgttttaacgcgtcgggagggctcccaacaaaagactttcgaacgcgatgacaagggtaatctggagctcattgcaagcaaacggatgggctattcgatgtcttcacaaaaggcaccggatcgacaaacatctagaacaagtatccgcaagcttggcggagctttcagtgaatcatatagatcccggctggataaggacggccacgagttaggtcgggatgtctccgcacatcgaagcctcctcaacaagcgttcagccgtctacgatgacgctacaggggagctaaagagcagcaagcacacgtttgggaagatatacaaagcggaagcgacatacctgaacgccgaaatcaaagaggtctccaaaaaaatcctcggagttacggtcggtaaagaattgaagacattaagtggacgcgaactcgaggctcaagtattacgtgccgcggaacgtgccctccataaacaggcctggcagcacccttcagctaacccctcgcggtcgcagcgggaaaataccaacagtcatcttggaaacgaacttgatgggccgctcgaatcggatatgaccgtcgtccatcaagccggatccgggttcgtcggcgacgatcgccacgttcatgatggcggtggatccaggttgaatgaattgcacgaatcgcgatcgtcgaatgatagggaaaagcttagttcgccgagagccgaaatttgcgaccgctcgatgaatcgggatcgcaccggctcaggtactttgtcgcgatgatagctaaactaggggggcacacaccgagttgtcaagtcgccccccggcaaatgagctcatccctgctgccatattcccaaactaccaacgtttcgcgtcaaaatgatcactgagaaatccgtgccatccccgaaaataactgccacgagtgtctcatcgaagcccacctgccgtgtcgtgcggcccggcagcacctatgccggaaaacagggtctcaattatttcgaagggattgcggccgagacagtgggctcgacggggatctgcatgcatcttttaaccataccgccgggcgcccgcgccaaggcgcatttgcacgcctcgcatgagacagcgatctatgcgatttccggagagacgcattgctggttcggcgaccagctggaagaacacgtcatcgttcgcgaagatgagatgttctatattccggctggcgttccgcatcttcccgccaatctcagcgaccggccggcgacagcggtcatcgcccgcaccgacccgaaggagcaggaaagcgtcgtcctgttgccggatttggaggggtatgtgccgcgttgaacgccacccggcggacccaacctggtgcaatgctacgagtcagtttactgtagggtaagcatccggtgaaggccgcaggttaggctgctttagctttcaatccgtgcggctgccaattccacggaagcaattgctcgagcttactgattggcgtgtcggcgatgcgggccaggaggtcagcaagccaagcctgcggatcgacgtcgttgagcttggcactttatgccgaccggcgaactatgcctattaatcaagttttttccaacgtttccggcagcatagcggtcgcccagtcggcatagcttagggtctctccgtcgcaattgacgcgaaggagaggacacatgaacacaactgactatttgaatcgcagcgccctatatcggaagctgctccacggtccgtatcgggagtttgcgcgtgtttacgccgccagcatgtcgaaagaaggcttgggtcggcaatgcacgtggcgctcgctgagcctgtttcgagacctgatggactggcatgttggcaatggatatgccccgcaggatttgagcgaagcttatgtcgatcgttttcttgagcatcgcttcaaacactggagtcccgatacgggcgaccgatcggcactccgacgcgtgctttcagcgttacgggaagagggcttaataccaggtgcgcttccggttgagcgcactgagcacgagcagatcgtcgatgtattcggggcatatctctcgaatgagagagggctcgccgcctcgacggtggggagctacaagcttctgtcacttcgatttctgcgggaggtctgtcctgccggcgcgaatgggtttgcagcgctcaccccggagattgtcatcgggtatgtcgaacgacatgcgctcgatggctccgccgacagcggcaaggcaatgtgcggagtcgtgcgtgccttactgcgctacttgcatttgaagggcttcatttcgacggcgttggccgattgcgtgccatccatccgccgctggcgacttgccggccttccaaccttcctgccgccagagaaggtccagaaggttctcgatgcctgtgaccggacgacggcaatgggacatcgggactatgcggttctgatgatcttggccaagctcggtttgcgcgctagcgaagttgctaccctcaatctcgatgatatcgactggcagtcgggcacgattctcgtacacggaaagggacggcggcaagcgactatgccgctgcgtcacgacgtcggaacagctatcgtggcttatatccggcatgggcgtcccgcttcggcgtgtcggcgagttttcttgcgaacacttgcgccgcacgtgggctttgcctccggctgcgccatcacgatgatcgcgaagcaggcactcgagcgggcaggcattgatggctatgcccatcacggcgcccatcttttccgccacagcctcgcgaccgaccttttacggtcgggtgccagctttgccgagatcggccaactgctccgtcatcgaagcatcgacagcacaaggatctatgccaagctcgatgttgacaagctgcgtggactgagcctgccctggccgggaggtgtccaatgagccggcttcgcactgccctcaaccgctatgtcggcatgcgccaagggctgggatacaaatatgatgggccggcacgacggttgtcggcattcgtcaccttcatggaagcccgcggcgccgagaccatcacgtcggacctggcaatgcagtgggtgacgtcgatgggccgacagccgagttggtccatccgcctggctgatgtgcgctgctttgcccagcacctcagtcatttcgatcttctgacggaagtgccaccgagcgacgcagtgccgccggcacggcggacaaagccctacatctatagcgacattgagattcaggcgctgctggcggcagcactgtcgctgccgccagccaacgcccttcgacgctggacgtatcactgcctgttcggactgatagcggtcgccggactgcgccattctgaagcgctcggcctgctccgggccgacgtcgatctcgagcagggcgtcctcactatccgagagacaaagttcggcaagtcacggctggtgccgct

SEQ ID NO: 25 - protein, 338 aa, Artificial
  Synthetic Construct
VGGSVMRRTNDLAVLIERWFTDRLMKHRGVSSNTIASYRDTFRLLFAFAQARLGRSPSQLTLRDLDAPFIGAFLEVLETQRAASVRTRNLRLTAIRSFFRYAAFEEPAHSAHIQRVLAIPSKRCDKRQLQFLTRPEIESILDCTDRSTWLGRRDYTLLLLAAQTGLRVSEVIDLDRDSVMLGRGAHVQCVGKGRKERSTPLTKVAQEALRRWLKEPGKRGATALFPNMHGGRLSADGVQALVFAAVYRAREHCVSLRSKRVSPHVLRHSAAMELLQAGVDCSVIALWLGHEAMETTLTYLHAHLELKESTLAKLKPYERAKAERFRPNDRLLEFLNAL

SEQ ID NO: 26 - protein, 315 aa, Artificial
  Synthetic Construct
MSFNSLSDVVKAVKEKTAAYESTEPKELHDIRTGTFAVGTNNQYFTNLDFVNGMLRDQSMYTWYPLLLTFQDERFTLEQCCALVHRFDYAYSNYLRYSGLQEMGAFAEAITKYLPTAGSRDEAVEAVKAFLGYLNRLAAWSFHYFPWSIGKHLTYETPEGSIAALADPSRRVQIRDGQKVRLTWEPLGISVIAYLATKENPELCNDLIQALPFTVVQDHAVVSGESMYAWAPVVSTAKVNVKERQCDAPVGRIRYSQGTGNKVIVQYGEVTEDIATPVLGEILPEYADDIYKVGRAVLESNFGDKKPIMLTIELA

SEQ ID NO: 27 - protein, 362 aa, Artificial
  Synthetic Construct
VSDAERFVSRCCEPNPNQGELTMKWQFGKAIVGGAMLVAACALSSGAQAQQKELIVSGFGGAYDEAMAASVKSFEQENDVKVTIVAGSGANNIARVRNKEVDVIVSDPVFALRMEAEKAFAPLDPKLVTNLKDIHPNAIYSDAVVAANFGAYVLAYNPAEVKPPQSWHDLAKPEYKGRIALRGFRPENIDLITLFAKEAGGDERHPDAGFAEMAKIAQNIDVWVDSHANHLELYRNDQISMSMWTDGRIGWARDTEGVKIQGVIPKEGFFPLASTLSVVAGRPNTELAEKLVNHLLSPASGLNMATRLGYFPTNREAKLPQEVQAKIMITPDNVKDLKSADWKYIVSVYDQWQQRWEREIQR

SEQ ID NO: 28 - protein, 303 aa, Artificial
  Synthetic Construct
MSLTPSLPQSDERRGLWERVVAWSTQAPLFLPFAFVILFFFVPMCWLVATSMSSHEVGSAPVFTGTLEHYARFWTDPFYLETALWTTVKLSVLSTVLALIIGYVLAYYIAELPADRRGFLTSMVVVSLSVNIVIRIFGLNVLLMSGGLIDSALTFMGMPKVRIMYTELGVLIGLVQIAIPYVVLPLIGVIAAIDPALKEAAASVGANKYKTFWAVTFPLSLPGVVAGTLIAFTLNAAAFAIPSLMGGGRVKMMGMMAYEQATVQGNFPFAAAIGISLTILSILITAIYLFAINQTFRTARRAA

SEQ ID NO: 29 - protein, 405 aa, Artificial
  Synthetic Construct
MKDKYRATGIEMSVATPASDEEIVVWRNAHLATVAGDRDGLGVVEGGAIVVRGDRIAYVGTDANLPALARGAVQVDLEGRWVTPALIDCHTHLVFGGDRAHEFEMRLAGASCEEIALAGGGIASSVNATNKFYEDELVLQDLPRLDALMEERLSTVEIKSGYGLNVEAELKMLRVARGLETLRPVRVVTTYLAAHAIPSSYRGRNGDYIKDVVIPGLERGRREGLIDAVDGFCENIAFSPAEISKVFDKATAIGLPVKLHAEQLSDLGGAKLAASYRALSADHLECLDEEGAQALAMAGTVAVLLPGAFYTLREKQLPPVQALRNAGTPIAIATDCNPGTSPRTSLLLTMNMAATLFGLTVDECVAGATREAARALGLLHETGTLEVGRSADFAIWNIGRPAELV

SEQ ID NO: 30 - protein, 289 aa, Artificial
  Synthetic Construct
MSLAFRTWLVLSPPFASRRREEIMSVFEVRHGTSPVILAMPHTGTDVPSEIWERLNDNGRQLIDTDWYIHNLYDGLLEKATVVRAMFHRYVIDANRDPEGASLYPGQNTTGLIPKTDFDGEAIWKSGAEPTDDDIAQRVATFHSPYHTALQSEIERVKAIHGLAIVYDCHSIRSHIPFLFEGTLPDFNIGTNDGQSCHPAVAAAVVNVVRNADGYTRTLNGRFKGGWTTRHYGTLESGVHAIQMELAQSTHLSAEEPPFSYDTAKAERIRARLRDILTNLERAASELKK

SEQ ID NO: 31 - protein, 561 aa, Artificial
  Synthetic Construct
MTNPRHNIREVRAPRGSELNTKSWMTEAPLRMLMNNLDPDVAENPHELVVYGGIGRAARTWNDFETIAATLKTLNADETLLVQSGKPVGVFRTHKDAPRVLIANSNLVPHWATWDHFNELDKKGLAMYGQMTAGSWIYIGTQGIVQGTYETFVEAGRQHYGGNLKGKWILTGGLGGMGGAQPLAAVMAGACCLAVESDETRIDFRLRTRYVDEKARTLDEALEMIQRWTKAGEAKSVGLLGNAAEIFPELVRRMEAGGPRPDIVTDQTSAHDPLNGYLPIGWTVAQHKAKRESDPKTVEAAARASMKVHVEAMVAFWDAGVPTLDYGNNIRQVAKEEGLENAFAFPGFVPAYIRPLFCRGIGPFRWAALSGDPEDIYKTDAKVKDLLPDNRHLHNWLDMARERIAFQGLPARICWVGLADRHRLALAFNEMVKNGELSAPVVIGRDHLDSGSVASPNRETEAMKDGSDAVSDWPLLNALLNTASGATWVSLHHGGGVGMGFSQHSGVVICADGSDDAAKRLERVLWNDPATGVMRHADAGYEIAIDCAKDKGLRLPGILGN

SEQ ID NO: 32 - protein, 188 aa, Artificial
  Synthetic Construct
MRVLRSAQYKRTMWKNGKGETVEIAVSPPDASVDDFDWRISTATVALDGPFSTFDEVDRTLSVLTGEGIELAIAGEPATVCSQNSPPFTFRADVPTTARLVDGPISDLNVMSRRGRFGHRVARCRLDGELEVGSDVAVVFVIVMSGCALKNSGERLESLDALHLDRAEKVVLRANGPTTAFVVELLPL

SEQ ID NO: 33 - protein, 203 aa, Artificial
  Synthetic Construct
MLSSMPGRLSTSPVRPSLSMLRSCAPVRLRRMVRAAYPPTRVTVRICARRWNIIRNSSPYARVENQRGGGVLAHFQSQPFRNRGFSGHKLAAAYLSDRHPDTGYCPKGTRACAVESRVSRYRSVVDRRRCGAGVFGFPRSAGPNEPRPSLQQGPERLQKGAVENANKRIRRFMPGDTDLAAVSQRDLTHLARHLKDQPRKCLG

SEQ ID NO: 34 - protein, 417 aa, Artificial
  Synthetic Construct
MGVKDLFFVEGQLCQRGSRAYKDFAPKMTAPIVQRMIDAGSIIIGKTTTTEMGWSGSGFSEFYGPTRNPWDPKLTSGGSSSGSGAALAARMVPFTLGSDGGGSVRIPAAFCGVFAMKGSLGRVPAWPWSATEMLSHAGPMSVTAKDSAFLFNIAKGPDPRDHQALPDDGADYTETRSTKSLRIGFAPSLFGFKVAPEIDRVVREAVDALTKALTIDVRSVSPDWEDPIRIFETLWVAGRGVAYGSQSDLSDFGSGFRALVEASARYDLKDYLSAAKARAEFAGRVHALFEDVDLLLLPTIPVEPFAADREAPEGFQSPSEVLAWTGWTPFTYPFNLSGNPAASLPCGLTVNGLPVGLQVVGRRHADALVMAFCQQAEDHLFKNNNPPLVVAGDKMGWGTPSKSTVEMSSWSSIEDRS

SEQ ID NO: 35 - protein, 283 aa, Artificial
  Synthetic Construct
MAPDAVVAMKAKELGLDRAIPLQFVSYLGHLATGDLGTSFVRPKSGASLAGSAYNDPTREERAKVLDLILDTLPMTLQLAAVALVIALLVAVPLGLAGGLYQGRWPDKLALALGSIFVSTPNFWLGIVLTLFLSVKLRLLPAIGYNGFEYTILPAIVLAVEIAPFILRTLTVSVAQVLREDFIQLAAVRGLSRGRTIFSHVLGNSAVPLINLLGVQLGMLLGGVLVVEFIFDYPGLGLLTINAVQQRDFPLIQGVAIFISVMFVVINILVDLIAMTIDPRLEY

SEQ ID NO: 36 - protein, 305 aa, Artificial
  Synthetic Construct
MTDIVELSATERTVVKRGTTPTRRMLQIAVGRLDFRIGLIGFGLLLGLAILLPFVSSVDPLKMAYSHKFIPPFPSEGWQWPYVLGTDQLGRDVLMRCLVGLCYSLFIGVTTVVLMFIVGCSLGLLAGFRGGWLDTVIMRLTDAQLSIPMIILAITILGVSRPTVPAIILVLGLSGWPLYARVARSVALGERNRGYVLGERVLGASDLRIMLLFVAPVVLPPIAFVAVLDIARMMIFESILGFLGLGVQPPTPTFGNVIADSRKYLLNAWWIATMPGLFLLISLTCLNLMGSALERARNAVLRGDA

SEQ ID NO: 37 - protein, 503 aa, Artificial
  Synthetic Construct
MGSLDPRLPIGHQIVEKLRSVRPDIGKAEAKEKVLDLLGRVHIPSPRSRFHEAPFQFSGGMMQRVMIVDALVSEPSLVIADNITQPLDVTVAAQIIRLIDSLRQSLDTAFLFISSSLPVVSQIAERTLVMQGGRIVERGKTADIAANPQQAYTRALLSRIPSIWKNVSAPEAKDGEAVLTVENATRTYSVRRRDAFNAFNEVKAVRDVSFTVKAGENFGIVGESGCGKSTLTRLLAWLEQPNAGRIAFLGKNLSSLSARSLTEMRKSFQLLLQDPYGSLPAGMSIIRMIEEPLLIHGVGRRDAEQRAQEAMREVGLHADLAERLPVGLSAGQRQRINIARALVLKPRLLILDETLSALDQVEQAELLDLFKRLQAAHGFSYIFISHDLALVRRICHRVAVMYLGRIVELADNTTLFEHPHHPYTRALLSAMPTLEENRFPGAQYLLDGEPPSPIHLPVGCSFRSRCPRAQSDCEKTDPMLVGSDGGNYAACLHRHEDEAVHVQ

SEQ ID NO: 38 - protein, 421 aa, Artificial
  Synthetic Construct
MLDAATTRRTDFDAIFDRISAIGAHPGAGVTRLAASAEDGMARGVFAVWMEQAAVQIANDAIGNQFACFDWAGQDAPWIFAGSHLDTQPRGGRFDGTLGVLTAGQAALAIHAEVQRGLCKPRYNLAVVNWTNEEGARYQPSLTGSTVFSGALALGDALELRDGDGVSLKRALEAIGVSGSSGIVPPPPKAYVELHVEQGRKLLEAGRKIGVVEGTWAARKKTVRWIGRAAHTGPTPMADRRDALLAAARGIAAFEAVVAASHPLLHRSAARLVVEPNSPNVVVDRATVWFELRGPDVAELDMAGELALAALEKAAAETGTQLEIVADTLRDPASMDRRLMALVDRTARSCGFEPLTMRSVAGHDAVALQNSGIPSALIFIPSVDGIAHHPDELTEPQDVQAGLAVLTATLRNIIEGEFHAG

SEQ ID NO: 39 - protein, 322 aa, Artificial
  Synthetic Construct
MAETGLMERAMRLRLGEGASQAEQAIEQAIIAVADWRGLEVSYEPVPGGISNPNWRVYVEGAPHSFFVKIPGAGTEMFIDRRTANEAGRRAHEAGVGARIIEFFPETGVEVSEFVEGLRTSTNADFLDPVIRLNGLRALKAFNDTAPLSQRKTTFDMIDEHFQQVLELGGDFPSDFGWMNARYREARAALEASGLDLAPCMNDTLAGNFLLHSDRRVMLVDFEYASTNDRAAELALWFCEMCFSPETEKELIEEYYGRADPGVLARIALFKALVDLKWSTWAMVQNEVSRLDFDFFKYGFWKHMRARFAMSNSLWPQWLKAV

SEQ ID NO: 40 - protein, 263 aa, Artificial
  Synthetic Construct
MQSTEEVISPDFLRRLAAVAARETLPRFRLPGAVVNKIAGGFDPVTEADRETEKALRALIRSEYPDHGILGEEFGNEGADAGLVWVIDPIDGTRSFISGIPLWGTLVGLTRDGDAVAGMMAQPFIGELFYATGNGAYYEGQHGQTRLATSATKNLADATLFTTTPAIFEADRRASYDRLEKQVRLARYGTDCYAYCMLAAGQIDCVVEAGLYPYDIVALIPIIEQAGGVVTDWDGGPAENGGGIVAAANSSLHAQIMAFLHGD

SEQ ID NO: 41 - protein, 772 aa, Artificial
  Synthetic Construct
MMISNCLTRNGFKMQIFHNALQLSHRMRSIKAKFAVVIIGTAIVSCASVGALSYQIGKNGLIEASKIRLEAIAANQSKALRAYDERVEQTLTEIAQSQSLGEMTEQAGKAIAMSDAKIREAFQDMSKSPAQRAAFDGSTVKMLYAVKHSSVHGPLFSAWKNADLSDIFVIDNNGQVVYTVTKGPEFMAAVQDSQNAALKSLFASSIAGPADQVYRTGFVSFKSEESDVSAFLAKPLANVVWGSVVKRGTVVIRIAPAKLLALISPEGLGRSVDEAFLIAADGTLRAGNVAAENGVPPELLKAANEQKNGSVFADGAHGSNFYSYVPVTLFGQPHLLVIGQSKANVVSSANELAKWAALTALAVLFGMGIVGYIFSSRLTKPLADITGLMNRLNNGDQAIEIRSVSRSDEIGIMARALESFRQGAVDKVRMEEEAIQRNRQIEEERQLRETDREKSAAELEHAVSALAAGLKNLADGRLDHRIATPFAPSLDQLRKDFNASMMHLQATMRQIRDNVEMIQGNGNQMAEAAEDLAKRTEQQAASLEETAAAVDEITVTVRSSAERAKDADQIVRQAKQSADDSAIVVNNAIDAMGRIEEASRQIEQITGVIDEIAFQTNLLALNAGVEAARAGDAGKGFAVVAQEVRELAQRSAKAAKEIKVLINKSTAEVNTGSHLVQETGSVLAKISSQIVTISQHVETIARGSHDQSSALQGVNSTVNQMDQMTQHNAAMVEETTAASRELASQADSLLALVQHFQIGGEDEAALAHSRAA

SEQ ID NO: 42 - protein, 380 aa, Artificial
  Synthetic Construct
MCLRGNGDPTSRGRRCLSKGGNLVNGYVKSILGATLLMASTAGPLWADEVKFMDGITPKAGDNPQTEAGKYKKDCGWVIGMSDFGVNANTWTVQVAHESEAAAAANKCIKKFILLDAGFDQKKQVADIEDLIAQKVDAIIVQPVTSTSANASMKKAIAAGIPVIVHTGRVETEDYTTEIQGGAEHFGKVMGDWLVKTVGDNGKIWVLRGLAGHPEDTNRYNGLLESLKGTNVKIVAEEHGDWQYDKGKSVCETLYLNSPDVDGIWSSGADMTRACVDVFKQFGAKIPPISGEGNNGFFGQWIHDGFQSISAEYSPAQGAEGVHAAVALLEGKQLYKHYDYNPPGWDLEKVKKYYRDDLSANVWWPSQLSEDDLKKYYTKN

SEQ ID NO: 43 - protein, 511 aa, Artificial
  Synthetic Construct
MVTERSCMDWEERMANLIEMSNISKSFGGSLALDRVSLELLPGSVHALMGENGAGKSTLMKILAGVHQPDSGEIFKNGHKIAFLNPKEALDFGISTVFQEMTLLANLTIAENMFLGREPVTRFGTVDYKRMNAETGKALKELSLDLDPRTLVSNLTIAERQFVEIAHGIKADASIFILDEPTAALNAADVEILNKHIRRLRDAGKALVYISHRMDEIFQICDTVTVLKDGKLIGTRPLSEMTPTSLIAMMVGRELKDLFPARNASAACEPMLDIKHFKIGASSKPFSLHVCKGEIVALAGLEGQGQQKLLRSLVGKFQPFSGTITLNGKSLALPVPNENGVRKLQQMGVGFIPEDRKEEGLFLNLPIAHNIEIALHSARAGFSPAKNYRKLVADTIKRLNVRTINASAPVGALSGGNQQKVLLGRYIAANLDILLIEEPTRGVDIGAKSEIYKLLRDFTQNGGAVLVLSRETVELIGLCDRIYVVHGDTVVADMPAAKATEHDILDAALSA

SEQ ID NO: 44 - protein, 320 aa, Artificial
  Synthetic Construct
MTKTLTRLFKGNQSRQGLWIVPLLITIVLSIALIIQTDQFLNRENLFNLVAQAMPLVITAVGQLFVILVGGLDLSVGSLISFTTAILALDAPGYITIPAVFLLAALLGLTNGIVITRLNVHPIIATLAMQYIVLGAARILRPVSGGTIPDVVISSVSGSFLGIPMPIFWGICVALVAWKLLYGSRFGLHLFAIGGGIASGVEDATRNFGVADKRNVILAYVACSCFAALAGVFLAGRIVSGDPNVGLLFELDAITAVAIGGTQLSGGVGSLQGTIIGALVLALLSNGMNLVNVSPFIQTAIKGGILLLVVGFQTRKKMGL

SEQ ID NO: 45 - protein, 317 aa, Artificial
  Synthetic Construct
MSAFAKNPAIQRMLKIAPAYYVFALLLIVLWVSRPQMLNANVMGIFIRQVAPLGVLVLGQLLVMRVKSIDLAGGGVILLVNYFISSGQFPGMSATGFVLLALFTGTAIGLFNGFMVGKRRVSAVIVTLAVSIILVGAVQFLSSGKPPGNVPSYFNDIYNVKLGPLPLPVLFWVVLTTLLSLLLSRTVFGRYVTSVGANAEAAHFSGVPVERTVVVAHTLAGLIAGIAALVQTASIAVGSVRVGLDLPILSVAATILGGVVFGRGEGGVWGPFFGVLSFALLFVVMTSFGVSDSGKLIAQGLIILLAAIFYGLKARTN

SEQ ID NO: 46 - protein, 227 aa, Artificial
  Synthetic Construct
MAESRSILCFGDSLTWGWIPVPESSPTLRYPFEQRWTGAMAAALGDGYTIIEEGLSARTTSVEDPNDPRLNGSAYLPMALASHLPLDLVIILLGTNDTKSYFRRTPYEIANGMGKLAGQVLTSAGGIGTPYPAPKLLIVSPPPLAPMPDPWFEGMFGGGYEKSVELSKQYKALANFLKVDFLDAGEFVKTDGCDGIHFSADTNITLGQAIAEKVKAIFSQEAKKAVA

SEQ ID NO: 47 - protein, 533 aa, Artificial
  Synthetic Construct
MARRRCKHAFLCGNGVTLRETDMADKIHDLFVIGGGINGCGIARDAVGRGYSVALAEMNDFASGTSSGATKLIHGGLRYLEHYEFRLVRESLMEREVLWAMAPHIIWPMRFVLPYQKGGIRPAWLIRLGLFLYDHLGGRKLLPPTAVLDMRRDEAAKPLKALFSKAFEYSDGWVDDARLVVLNARDASDKGALIMPRTKVVSARRENGLWTIETVDTVSGIAAVHRARMLVNAAGPWVDHVIRGAFGKNEARNVRLVQGSHIVVKKKFEGPRAYFFQNPDNRIIFAIPYEDEFTLIGTTDRDFSGDPKDVRISQEETEYLCKAASEYFKEPVRQDDIVWTYAGIRPLFDDGATKAQEATRDYVLKLDGFVGSEVNRAPLLNVFGGKLTTYRRLAEHALEKIGEAIGTKGAPWTAKSHLPGGDFPVQGYEAEVTKLHKAYPFLAASHARRLVRRYGTRASVLLGTAGKIEDLGRLFGSDLYEAEVLYLMAHEWARTTNDILWRRSKKGLHLSHSEVALLDQFISEIIQRQVAAQ

SEQ ID NO: 48 - protein, 652 aa, Artificial
  Synthetic Construct
MSDKIYPVTKPVESHALINKAEYQEWYEESVASPEQFWGKHGKRIDWFKPYTRVKDTSFTGDVSIKWFEDGETNVSYNCIDRHLATNGDQVAIIWEGDDPSLDRKVTYRELYEHVCRMANVLKKHGVKKGDRVTIYMPMVPEAAYAMLACARIGAIHSVVFGGFSPEALGGRIVDCESTFVITCDEGLRGGKPVPLKANVDKAIDIAARGHVMVKNVLVIRRTGSPLSWAPGRDLWHHEEAATVSADCPPEPMNAEDPLFILYTSGSTGKPKGVLHTTGGYLVYASMTHEYVFDYQHGDIYWCTADVGWVTGHSYIVYGPLANCATTLMFEGIPTFPDAGRFWDVIDKHKVNIFYTAPTAIRSLMGAGDDFVKRSSRSSLWLLGSVGEPINPEAWEWYYHTVGDGRCPVVDTWWQTETGGIMITPLPGATDLKPGSATRPFFGIRPELVDAEGKPIEGAADGNLCIADSWPGQARSVYGDHKRFIQTYFSTYEGKYFTGDGCRRDADGYYWITGRVDDVLNVSGHRLGTAEVESALVSHHLVSEAAVVGYPHNIKGQGIYCYVTLMAGSEGSEELRQQLVKHVRAEIGPIASPDKIQFAPGLPKTRSGKIMRRILRKIAEDDFGSLGDTSTLADPAVVDDLIVNRQNRAEAA

SEQ ID NO: 49 - protein, 194 aa, Artificial
  Synthetic Construct
MRLILMGPPGSGKGTQAKRICEKLGIPHLSTGDILRAEVKAGTPLGLAVAATMAAGGLVSDDTVSAIVANRIASPEAQRGFVLDGFPRTISQAASLDQSLGEHSLTAVIELVVPEEELYDRICRRAAESAGAQRADDNAATLELRLKAYRAETLSVSEFYKGRSPYFQVDGLAVPEEVTARILEILESAAAEYS

SEQ ID NO: 50 - protein, 734 aa, Artificial
  Synthetic Construct
MGPRYLGWRIMSIHFDFLLLRGPIRTKIFCLLTPILIGIAGLSLVNYLSGNMLNTQLASSSSGMVTLSAIKQAQDGMNSFLLEATEAKRDALKALLADQSAKISTSLSFAQEQDERQSLVAAGTIAEEVSRTIDGLWDMHSDERKLREGISSDLATLSDVQSKLQTYLNIPADQAAAQAATAETLNKINSMNYELRIAASDFLGGMNDDTLKKVKGRLKGLGFYLGKVKEQHAANGPIQELASKAIDVIGGTSERFDQLLVKVGERDAAFKAASASMNDAWNKILLFADIQRGHASAAQDQAQTISLVTTVIALLFGCVAGYLLLRTIKSPIEALTASMKAVASGKLDEKIGSVETRDEIGEMARALDVFRHNALEKIRVENEAEQSRSLARQQRQEDDLRKTRDAAAISNAVEAVASGLHKLASGDLTVTIGRPLDGELDQLRQDFNASMLHLQATMRQIRDNVEMIQGNGNQMAEAAEDLAKRTEQQAASLEETAAAVDEITVTVRSSAERAKDADQIVRQAKQSADDSAIVVNNAIDAMGRIEEASRQIEQITGVIDEIAFQTNLLALNAGVEAARAGDAGKGFAVVAQEVRELAQRSAKAAKEIKVLINKSTAEVNTGSHLVQETGSVLAKISSQIVTISQHVETIARGSHDQSSALQGVNSTVNQMDQMTQHNAAMVEETTAASRELASQADSLLALVQQFRIEGNAREFGFSNAEELSHQRPASQSAA

SEQ ID NO: 51 - protein, 335 aa, Artificial
  Synthetic Construct
MTITPDIELGAYLHETKVDPALASLVESIAASAIVVADHLKEAAFQNHIGSSGTTNVQGEDQKLLDVLADRVFRETCGEAVSLAAYVSEEAEEVTWLKPPAAGDLILYVDPLDGSSNLEVNLSVGSIFAVSQVQADGDTNVLRKGREYLCAGYAIYGPSTLFVITFGLGVVGFTLDPSDGQFKLTNARMRVPTETTEFAVNSSRQRFWDEPIRRYVDECLAGSAGPRGQDFNMRWTASMVADVHRILTRGGVFLYPADESNRRAGGKLRLMYEANPMAFLVEAAGGAASTGTEDILRIQPQAHHQRVSVLLGSSNEIQRLVQFHQIHHSQEEIGS

SEQ ID NO: 52 - protein, 346 aa, Artificial
  Synthetic Construct
MALVTLRQLLDHAAENGYAIPAFNVNNMEQMLAIMKAADRTDSPVIMQASRGARAFAGDATLSHLIRAAIEMYPHIPVCMHQDHGNSASTCMSAILAGFSSVMMDGSLSEDGRTPLSFENNVAVTAKVSEMAHLVGVSVEGEIGHLGSLESGRGEAEDGHGFDGELSRDMLLTDPEEAAEFVRLTKVDALAIAIGTSHGAYKFSRKPDGDILSIKRLKEIHARLPDTHLVMHGSSSVPQELQELINAHGGEVKPTYGVPVEEIQEGIRHGVRKVNVDTDLRLAFTGAIRRVFALHPGEFDPRKYLAPGIEAMAAVCGDRYEQFGAAGHASAIKPLPLAEMAKRYSH

SEQ ID NO: 53 - protein, 236 aa, Artificial
  Synthetic Construct
MNGLTADLAEIEKVAWNIGELNADVAICPPATLLQSAVRIIAGSRLLLGAQDCSAQEAGAHTGDISARMIADSRARVVILGHSERRQYQGETDAMVRRKAEIAVSAGLMPVICVGETEAEHLRQETLTVLKNQLQGCLPAEMNELALVIAYEPVWSIGTGRLPEQSEILAAHACIRSSLIDAYGSIGAQLRILYGGSVKPENSAEILALENVDGVLVGGASLRAESFLRICEATGR

SEQ ID NO: 54 - protein, 163 aa, Artificial
  Synthetic Construct
MLAAGRRAANPRPFNDRDGDEMTNHVNNQSKAKAPSPIDVEVGASVRGMSQSTLAEALGVTFQQVQKYEKGTNRVGASRLLNVATLLGVPVSYFFDSQSRDGKPDGLTGTGAEMELSAFLDTDEGRDLNVAFARIARPALRRQVLSLVKAMAATDVKGSRGNA

SEQ ID NO: 55 - protein, 194 aa, Artificial
  Synthetic Construct
MVQQVSELLDGPVTADLHFDRIVDLTTEKGLRLAALGHLVWSCLNLSDADRLAPAAIERLFESTMIALLEVVPNSYMPRLERPVSPAVPRQVKRAIEYMHANLSQPLTVASIASETGTSVRALQVAFQRFKGTTPLGYLKTIRLEAARRALVDDTGSRSIADAARSAGFTHMGRFAAVYYQAFGETPSETIRTR

SEQ ID NO: 56 - protein, 429 aa, Artificial
  Synthetic Construct
MASSLLTRSTPVTPLRSSMSSSPGRLIEPAASAFGVPLARGRPQGRLRRGRVLHDPTIVSRALAAFALRGGWSAPAKRRARKAMRKSMDRKEIEALRDQVSCAAVLEQAGFAIDLKESTRRAVKFRRSGEIIIVTHDGRGWFDPLGDAKGDVFGLVEHLDHVGFLEGAGRVAGLVGFAITEPEWQAPRPDRDLDLSLPERWQARRRPWPSSSTWAYLNGERFLPATLLRATIGQDRLREGPQGSMWAAHTDNAGVVTGWEARGPEYRGFASGGTKVLFRLGPDPALRLAVTEAAIDAMSLAAIEGLRDGTVYLSTGGGWSPSTEAALRQMASRADSLLVAATDGNPQGEMFAERLRALADTVGCDWSRLRPPEEDWNETLKIREKEKRERKEGGVPHSRRPRQGKLRPGEPALDPAGRDAGGPGGVMKD

SEQ ID NO: 57 - protein, 201 aa, Artificial
  Synthetic Construct
MYPSPAIRKVFHGVASRQQMFRMFDRHAQRPNRWDGDASLLYSGEWFEIAETEHDYMFEILPPLWIRGSMFAMREYLTGSVTSVFFALRIDGVIRHFHGYCDLSDKGAVERMRVAIIERESRPVRAMTREERLEHIWSITADDYRGYAGDRWDEAARGKRTIMLYGGAVGSTLKLLDELTDDEIAAKLPVQLRHLPSPIAA

SEQ ID NO: 58 - protein, 133 aa, Artificial
  Synthetic Construct
MLSFPLTSVREVVARSRADAEANGGFRNPYYGLRPGKDEKPGLWLVGDQGVYLLSNGKLPDGAKPLVVYAEECDPRTNDDWFAVKRRTFGGDDGVDFVDAEQLEAMMAAAPEATHLRIAFLQDSMQLFLVAKP

SEQ ID NO: 59 - protein, 1702 aa, Artificial
  Synthetic Construct
MSNDPFTLDMFGSSALSSGLGLGVTPFGGFDTVAANDDDPEPTPPSPSPALPAAAIERPAPRRQGNRCNFYLDDADRGLAGSWKDRARANVAAILIANNIEKQDRPANAKEQAQLIRFTGFGASELANGMFRRPGEVDFRAGWGELGGSLESAVSDADYASLARCTQYAHFTPEFIIRAIWSGLQRLGWCGGRMLEPGIGTGLFPALMPAAFRDRTFVTGVELDPVTARIVKLLQPKARIINGDFARADLAPIYDLAIGNPPFSDRTVRSDRTYRSLGLRLHDYFITRSIDLLKPGALAAFVTSSGTMDKADATAREYIAKTADLIAAIRLPEGSFRRDAGTDVVVDLLFFRKRKVGEPTSDLSWLDLEEVRPESQDEGAVRVNRWFAEHPNFVLGDHALTSGPFGETYTCQPRAGEDLQAALKNVVRLLPEGRYDGEPTAIDVDLEDELGEIIDLRPGDAKVREGSFFIDNRHGLMQMVDGAPVEVKVRKGRTGDGIPEKHVGIIKKLIPIRDAVREVLRAQEQDRPWRDLQVRLRIAWSSFVRDFGPINHTTVSISEDEESGEVRETHRRPNLQPFLDDPDCWLVASIEDYDLDTDTAKPRPIFSERVIAPPAPPEITSAADALAVVLNERGRVDVEHIAELLHRHADAVVDELGDAIFQDPADGSWQTSDAYLSGAVRTKLGVAEAAAALDPAYERNVRALQAVQPADLRPSDITARLGAPWIPASDVVAFVKEMMGAEIRIHHMPELGSWTVEARQLGYCAAGTSEWGTSRRDAGELLGDALNSRVPQIFDIYKDAGGERRVLNVVDTEAARDKLQKIKEAFQNWVWTDPDRTDRLARVYNDRFNNIAPRKFDGSHLKLPGASGAFVLYGHQKRGIWRIISSGSTYLAHAVGAGKTMTMAAAIMEQRRLGLIAKAMLVVPGHCLAQAAREFLALYPNARILVADETNFTKDKRLRFLSRAATATWDAIIITHSAFRFIAVPSAFEQQMIHDELELYEDLLTKVDSEDRVSRKRLERLKESLQERLEGLATRKDDLLTISEIGVDQIIVDEAQEFRKLSFATNMSTLKGIDPNGSQRAWDLYVKSRFLETKNPGRALVLASGTPITNTLGEMFSIQRLLGHEALAERGLHEFDAWASCFGDTTTELEIQPSGKYKPVSRFASFVNVPELIAMFRAFADVVMPADLREYVKVPDISTGRRQILTVKPTPAFKAYQQILDARIKAIEMREGPAEPGDDILLSVITDGRHAAIDLRLVIPANDNEEDNKLNLLVRNAFRIWQETSDDTYVRPDGKPFDLPGAAQMIFSDLGTINVEKTRGFSAYRWIRDEFVRLGVPPSEIAFMQDYKKTEAKQRLFADVRAGRIRFLIGSSETMGTGVNAQARLKALHHLDVPWLPSHIEQREGRIVRQGNQHDVVDIFAYATEGSLDASMWQNNERKARFIAAALSGDTSIRRLEDFGEGQANQFAMAKAIASGDERLMQKAGLEADIARLERLRAAHDDDQYAVRRQMRDAERDIETSTRRIGEIGQDIGRLVPTAGDAFAMTVLGKLHHERKEAGRALMKEVLTLLQLQQEGEVHLASIGGFDLVYEGERFGKGDGYRYATTLQRTGAAYEIDLAVTVTPLGAISRLEHALDGFEEERERYRHRLDDAHRRLVSYRSREGGTFAFADELAEKRRQLRDVEDALAAASVQNDAASAESA

SEQ ID NO: 60 - protein, 583 aa, Artificial
  Synthetic Construct
MHIMKVDPRSLKDNPDNTRQSKSTPQADALLLATIKAVGIIQPPVIFPQSDGGNGYVIEAGHRRTRMAIAAGLEEIEVLVVEAANDNGAMRSMVENIAREPLNPVDQWRGIERLIALDWTEEAIAVALALPVRQIRKLRLLANVFPAMLDQMALGDMPNEQQLRTIAAAHLDEQKEVWKAQKPKKGQPATWFQIANALSKTRMYAKDASFGDDLREAYGIEWIEDLFAPADEDSRYTTNVEAYLGAQQEWMTNNLPKKGVIAEVTQWGDVKLPQKASRVYGKPGKGDHTAMYLDRNGKVQTVHYRMPEEKKTAGKRAVVGGGATAGDDVIDAPKQRPDVTQKGHDMIGDLRTDALHEALARAPIEDDTLTALLVLAFAGLNVRVDSGANDTVFGTKRFARHAVRLLDSDGKLSFEIDTLRVAARSMLVDVLSCRRGMSNSGIVSRIAGEAIGADGYLPNMGTEDFLLCLSRAALEASCKDTPVLPRPKVRETRAALVEHFKEGHFVHPAALFAPDPKELADLIKKGEIVEEEDSVTTEETSDGLGELADDSAAGEAAELDAPDPEADDGAPDEDETAYGIAAE

SEQ ID NO: 61 - protein, 168 aa, Artificial
  Synthetic Construct
MNRRIPRRCLMSASLIYDLAPIGSIVAWSDGSPRPPERFKKKLAAWQTRNSKGRLIRKEGPRQSGNYASPGHFTLHEADFGGKNTVVMRIHRTFGLDSDLAFKVLERPALGSIRLFDRAGANAELVHLAGNHEAAVAWLKEHGYPNAILEEVTADEVAAAHVEGRVAA

SEQ ID NO: 62 - protein, 114 aa, Artificial
  Synthetic Construct
MAAMPIHHAQLARMEEARRQTQRQLELIDRQVLRRITSILPQLARRQTGYRRGKAPDTGFFLERYRNNLAALTAERQPEVDALTRKLARQDAAIAAFRKRFEPVGDAAQPRAEV

SEQ ID NO: 63 - protein, 154 aa, Artificial
  Synthetic Construct
MGTIGDLERSAGIGPSSAERTAFWQQFHHLNGKACLDAGVAELKRMIAAREEQADVASSKQRAVPKRERLPPLSGEQEAALQAYAARHGRRWKSILNNVWMGGAPYDDGGTLRGLRNTHGPSWLQYYRLPKPKPSAETIIAPIERAASSGSDDV

SEQ ID NO: 64 - protein, 195 aa, Artificial
  Synthetic Construct
MAKPATSPRQSARVVALRKGATVEMVRLTCPDSAQALKIAESFGTAIVDSDGIRDLHERLISETADALSDGLGEKAMQIHLQRIVGAFVGSAHGAGQFYSRAVTEARDATAKAANDARDEDLDGPVGYDSAAQRRREFAADMGVQAHALRVAAEGAVAAYKQIVGEAWKPFDRPVENPGHSLDRKAAEAQMSAFD

SEQ ID NO: 65 - protein, 405 aa, Artificial
  Synthetic Construct
MPVPNSMACRSSPLRMSSGRPTSKQFLESPEAVTPRSARREPVRLLVLAERGVRATASPSSTSVPAFRCPHPFPLRTLDRRDGVAIGATSLNWRFEMSRKDEGQRADIYTRITDKIIEDLEKGVRPWMKPWNAANTNGRITRPLRHNGQPYSGMNVLLLWSEGLARGYSSPMWMTFKQALELGSAVRKGETGSTVVFASRFTKSETDRNGNDVDREIPFLKAYFVFNVDQIDGLPDHYYHRPTPVLDPIERIEIADRFFRDTGAVIRHGGSQAYYSPVTDHIQMPPFETFRDVESYYATLGHEEIHWVGAKDRLDRDLSRYAKDRTERAREELIAELGSCFLCADLGIAPELEPRPDHASYLQSWLTVLSNDKWAIFQAAAHAQRAVSYLHGLQPSAEGADKAAA

SEQ ID NO: 66 - protein, 173 aa, Artificial
  Synthetic Construct
MGCCGMLRRTNIGCEDINWKGQAVEKYVGAKLHGIRVTDAKLNYHGSITIDADFCREVGLKPLEYVEIWNKMSGARISTYVLYGDPGSRCCILNGAAARTCQQGDEIIIASSVFCEIDDIIKLKPRVLVFGENNEIVDRITYEVFRRADNSLDMAVSSELPDNSYGFPASISG

SEQ ID NO: 67 - protein, 363 aa, Artificial
  Synthetic Construct
VRGQTVLGFAKQKQYALLLGAALLLGHSARAQDIDLMNGVVARPGDKDTIPAEKFKKASPWKIGMSHFGVNANTWAAQMAAESQAAAKSDPRISQFVLLDANLSQAKQIADIDELIAQKVDAIIVTPVSPTSADAGIEKAVNAGIPVIVHTGLTKTDKFTVDIQGGGENFGKVSGEFLVKELGGKGNIWVLRGLPTHPEDINRYKGLLEAIKGTDIKIVAEDAGLWSYDYGHKVCETFYLENPKVDGIWSSGADMSRACMDVFQQYGAKVPPITGEVNNGFLQKWIDSGVDAIATEYGPEQGAAAVRAAVALLDGKAIHKRYVYEPDGWDIQKAKANYRADLSEKFWMPSSLTDTDLKALYGK

SEQ ID NO: 68 - protein, 769 aa, Artificial
  Synthetic Construct
MTPATAKSNDRRNFGIAGRLTAAFVGIAALAAIAGASSSWYSMKSSGIVKELGDRTLPTVTESLAFAQESAILLAEAPNLVYEPDLASLDASSKRLEAILAGQSGRLTALRDLGVAPELLDSVEKTSQSLEPKLNQLTAISSDRIKAKFRMQEGVARALSRYKSLASMLRNAQVGAVDSSIERSRALTDLQMAAAEISTLISAIPDASDTELAAVKDQYDATGKEIDSILARLKASGGSAAMQQLVTALQNEGGGPEGLFALRSAQAKVNGQIADMLNDLTVTSIILGVDVKLIAAKEKQAARNAAELSRGMTQQTVAVNAATSFLVIAAALAALFYVRRFVTRRLIRLATVMGRIASGDHSTQVPMSGRDEITDMAGAVEVFRANAVANIRLEQEAEEQRNLTEDDRRRKAESDRLRAEAMAQATQGLGKGLKHLSAGDLTFRLSEPFADEFETLRADFNGAAGQLAETLRSVADAANAIDSGSREVSISADDLSKRTEQQAASLEETAAALDQITVNVANSSKRADEARRIAAQANTSASQSGQVVASAVDAMEKIEQSSKQVSNIIGVIDEIAFQTNLLALNAGVEAARAGEAGKGFAVVAQEVRELAQRSAKAAREIKELIRNSSVEVENGVKLVSETGTALKTIEGYIVTVNQHMDSIATSAREQSVGLAEVNTAVNQMDQVTQQNAAMVEESNAASATLAGEAGRLRDLISQFQFGEAMRRPASLTEASPSSRPVASPARRIVGAVAKAFSGNAAVKQTWEEF

SEQ ID NO: 69 - protein, 1108 aa, Artificial
  Synthetic Construct
VAVPHFSVSVVARGSGRSAVLSAAYRHCAKMEYEREARTIDYTRKLGLLHEEFVIPADSPEWVRSMIADRSVAGASEAFWNKVEAFEKRSDAQLAKDVTIALPLELTSEQNIALMRDFVERHITAKGMVADWVYHDAPGNPHVHLMTTLRPLTEDGFGSKKVAVLGRDGKPIRNDAGKIVYDLWAGSTEDFNAFRDGWFACQNKHLALAGLDIRIDGRSFEKQGIDLEPTIHLGVGAKAIERKAEQSDGKQETAPPKLERIELQEARRSENARRIQRRPEIVLELITREKSVFDERDVAKVLYRYIDDARLFQSLMVRILQSPEALRLERERMNLATGVRELAKYTTREMIRLEAEMANRAIWLSARASHGVREAVLQATFARHSRLSDEQRTAIEHVAGGERIAAVIGRAGAGKTTMMKAAREAWEAAGYRVVGIALAGKAAEGLEKEAGIPSRTLSSWELRWNQGRNQLDNKTVIVLDEAGMVSSRQMALLVETVTKAGAKLVLVGDPEQLQPIEAGAAFRAIAARIGYAELETIYRQRQQWMRDASLDLARGNIRKAVDAYTAHGRMIGLRLKDEAVESLIAAWDRDYDPSKTSLILAHLRRDVRMLNDMARAKLVERGVVAEGFAFKTEDGHRKFAPGDQIVFLKNEGSLGVKNGMLAKVLKAAPGRVVAEVGEGEHRRQVTIEQRFYNNLDHGYATTIHKSQGATVDRVKVLASLSLDRHLTYVAMTRHREDLAVYYGSRSFAKSGGLIPILSRRNAKETTLDYEQASFYRQALRFAEARGLHLMNVARAVARDRLEWTIRQKQKLVGLGARLAAIATKLGFVGNFKNSPIQNPIKEAKPMVSGITTFPKSFEQAVEDKLAADPGLKKQWEDVSTRFHLVYAQPEAAFKAINVDAMVKDQSVAKSTLAKVADAPESFGTLKGKPGLLASRAEKQDREKAIANVPALGRNLERYLRERAEAELKHETEERAVRLKVSVDIPALSPAAKQMLERVRDAIDRNDLPAGLEYALADKMVKAELEGFAKAVSERFGERTFLPLAAKDTNGKAFETVTAGMTAGQKAEVQSAWNSMRTVQQLAAHERTTEALKQAETLRQTKSQGLSLK

SEQ ID NO: 70 - protein, 387 aa, Artificial
  Synthetic Construct
MRREFLRATQLIVASIAIGVVGWSGHALLLPVALAFPVLWSMAQTRAVAALVSASYFLAASRGLPQGVAAFYSSDIWPGLLLWLCASSSFVAVHTVLWTGIAGIRPFRYLLAAVIMAVPPFGITGWAHPVTAAGVLFPGWGWWGLGWMTAGLAGLVTRIWPAVAIALTGFWLWSAAIWTDPRLPEAWRGVDLEMGASLGRDTGLRRQHDLIATVRDAAGDGTRFVVLPESALGFWTPTVERLWTGALADGDATVIAGAVVVDADGYDNVLVSIDGKGRRILYRERMPVPGSMWQPWRSWFGESGGARADFFANPIVTIGAGRAAPLICYEQLIVWPVLQSMLHDPDAILAVGNGWWTEGTSIIAIQRAATTAWVKLFAKPLVIAFNT

SEQ ID NO: 71 - protein, 204 aa, Artificial
  Synthetic Construct
MLDAALIKECADPSLKPAIVERFVVSAGSADPLAVTVKSGGRLILVPKAASADEAMVIVRQYAGQAVVRVGLTQFPAGVGVKEASDLKPDLVDACQNLRKGTAMFAKVLRIVAKWYGNPTSKDVFPQIFEDAVYAWKTGEFEGVSVFQAEDPGTAVEVPQQSEEKIPDEEESAEPKPGEQEPETVQDVGRAGMRIDLSHIGGQK

SEQ ID NO: 72 - protein, 107 aa, Artificial
  Synthetic Construct
MKDVNLSETKHETKPMGSCLRSMEKSELEALAISAIREHRRLIVADEAVYEEWTRASADPSVSSAVLESLQQEYAARQRKSEAQQEELSEIIDVLGYIPEVPLDGDE

SEQ ID NO: 73 - protein, 424 aa, Artificial
  Synthetic Construct
MRYLETAITRLTLINRLKPEAQVNVIDRHINRASTSAHITQRAEALSARLRAVGERAFPPTAQKSLRSFTSGEVAEIVGVSDGYLRQLSLDGLGPSPDLGSAGRRSYTLEQINQLREYLAGARPKEASRFWPRRRSGEKLQVITVANFKGGSAKTTTAVYLAQGLALQGYRVLAVDLDPQASLSAMFGYQPEFDVAENTTLYGAIRYDDQRVTMKDVIRRTYFTGISIVPGNLELMEFEHQTPRFMLQNRGRPEDLFFRRVAGAINQVEQDFDVVVVDCPPQLGFLTMGALNAASGMIVTVHPQMVDVASMSQFLLMTSDLVSVIEEAGGRLDYDFLRFLITRHDPRDVPEQEIVALLRDVFGIDVMAASAWKSTAIANAGLTKQSLYELSRGAVGRTTYDRAMESINAVNLEIIDQINKVWGR

SEQ ID NO: 74 - protein, 335 aa, Artificial
  Synthetic Construct
MSKRTQSIRSMFAGGNDQTASNDAQQPVQRVASGAVRSLKDTFSEVERHYEELKQQVADGAVPVEIDPELVDPSPFADRFEDQDMAVLEVLKTSIKDHGQEIPILVRPHPAEIGRYQVAYGHRRLRATAELGLKVKAYVRELDDDRLVVAQGIENSAREDLTFIERAAFALKLDEGGFQRSLIQMALSVDRHEAQKLVTVARAVPQWLIDSIGRAPKIGRPRWQELAELLKVPGAEKKARKATQDKSFSHRDSDNRFLVVLRASKIDDVTAPSVAPTRLVAKSADGLQIATLAIGGKQCKIEMNRDRDETFAKFVMEQLPALYANFRKENPSSEG

SEQ ID NO: 75 - protein, 403 aa, Artificial
  Synthetic Construct
MQSGNVTTPFGRRPMTLALVAAQFKSADIRQGKSADKWKIYRDACDARSLLGLRDRALAVLNALLSFYPEAELKEEANLIVFPSNAQLAARANGIAGTTLRENLALLVDAGLIQRNDSPNGKRYARKSSDGSIETAFGFSLAPLLARSEELAVMAQQVAEGNRKLKIVKERITIARRDVRKLISAAMEDHVPGDWAKVEELYVEAMARLRRAKGADELIGILDEVEMLKEEVVNLLERHVNLGKSDANDDGFRQHIQNSNTESSNELEPCSENEQGAKQSKNVELRAESIKSFPLGMVLRACPEISMYGPGGAIGSWRDLMMAAVVVRSMLGVSPSAYQDACEVIGAENAAAMMAAILERAGHITSAGGYLRDLTSRAKRGEFSLGPMLMALLRANGGEQRRA

SEQ ID NO: 76 - protein, 196 aa, Artificial
  Synthetic Construct
MRTPRSNFIVEYKTNRRQTLRRTSIWGDLDLQAVARAVEADDVMPKLDLPQAASVQEDVVAVKFEVVDYSDVPIDGEVPPDSPAATSSSKEFSIESEAVEDDASDPTRSVHQQRSPGSGWTPKSGAKARSKKTPSASPASAPILNLRRDPPLLCGLDEELAALEAENRHLRSLMVVKLRKENERLKFMLRRFGQSR

SEQ ID NO: 77 - protein, 317 aa, Artificial
  Synthetic Construct
MDSFDPSAPTAPAWSPRMPGWALPRGRDITESDAAFAAGIALKSLDDLIRADPPWLGCWRDRLALKSAAVAARMLGRNEEETAIRDAILLTAPGNDPGPAGKLFLAIRMLTRQSGTIATPFVKELCALLGIGWEDALVSVPDFVDTAIQSGRAAPLAVAELVSAITTIRPDTEVLSLGLAEIVLALMLNWPKPVPLLIPERFGEAFRTIGGRGRVRSGEAAYPRAICLALMDGVAAALRSAVEIDRRAARLLAVAPKLRTRGAEPVIRRLLSDDAILASVPGSELSRWAANRLFDRLESFEAVRELSGRSSFRIFGL

SEQ ID NO: 78 - protein, 111 aa, Artificial
  Synthetic Construct
MRAAYFCICDPDEGAVTGANCRISSWTTVLSSNGPSERPSKAKSEWETGPRRSGEAWCDGDGIAIGRSMARRIDRDEHRRLHHHRPHTCSFSARPPSRHAAPRGEPHILQD

SEQ ID NO: 79 - protein, 376 aa, Artificial
  Synthetic Construct
VIMTIEMKNVLELADAALSADYTRVRRAANALARDLDKNGETSIAKELKALVRKRGVPLKASGYVESLPVDSKSRLPLVEEQTWPDTPIFLNEGGWHVFSDFIADARRIDDLSAKGLASRLGLLLSGPPGTGKSLLAGHIAAQLSRPLYVVRLDSVISSLLGDTAKNIRSVFDFVPARNAVLFLDEMDAVAKLRDDRHELGELKRVVNTVIQALDGLDPSSIVVAATNHAHLLDPAIWRRFPYKIELGLPDESVRADLWRHFLFEDKDEERRAELFAVVSEGLSGADIETMSLSARRHAVHESRDIDFGAVVVALLEPRSGRTVPVQRQPLDAEQKRQVAIALKEKYAIGGADTARILGVSRQAIYAYLKQQEGEV

SEQ ID NO: 80 - protein, 371 aa, Artificial
  Synthetic Construct
MVEPRDQPLLYPVLSLQMDPALRSPTGRGKGIDSIVKERLGRQQDVLASETRDIYEHRTELPTYSGLTHLVVRMFSEDSLAPTHTPDDLFSQRHGCRLVAPLPGGYLIEAEVKELPRLLRAIEHPIGYAVQADISRVSSLGQFDAKSRLRGRSFNELWNSAPEDDDGRLFVVWLAPFRDRDAKAEVLERIQRFANERLVMPTFTSVRLTLGTSEESEEPRSLTTPRQSSIARAMRDYRNTGVGRAAVRIPNKEGLRQLIASGASYRIDPVRPIRVAAPGEGAEPPAPVIDENAPIVAVVDGGLHARSYTAAEAFRATPFVTNAQADKPHGNSVSSLVIHGHAWNKKSLAASTKLPYRNCSGRPPSERQSAL

SEQ ID NO: 81 - protein, 346 aa, Artificial
  Synthetic Construct
MYFKERCASLARLADIGYDTWYAELAFSTTRENMVDGVEIDTQGLHLSPINCGPAGLITHRLWSKQLKTQTNHILRLNHVTIPPSTFLETKKMMEAICLEQPLVANPRPGPRTQGYEFGIEGFEFVAFDHLVTGKRCFCSCARLAHEKMMSEAIRIASHSGAWTHQVVRLLSDATYIDEICHLCIARRSGPEAAASFYGDDIGEFITPYIDQLMLMSGMDKSTARSEVQYTLGVRRWMREAEMYSLVKKLFPDQVILREASPPWLGRQRFDVYLPAIGLALEHHGEQHYRAITAFGGEVALKRNMERDALKRSLCEQNAVQLVEIRFDEQMTLPLLRRKLRRFIMA

SEQ ID NO: 82 - protein, 166 aa, Artificial
  Synthetic Construct
VGIMRRDEVGEDLVSLAFDFLYFFARFEYALKANGYLKKTEPGQPAEAGWRQFRERWEGDYKSSEAAVALIAANPKKQIIGDDGMLAFRAVGFPASTCELGQVIGYCQTVRNNLFHGGKSSTDGFDSPERTKCCFPSFSSCSRNWPALSILVLTIPATTKTLIDEE

SEQ ID NO: 83 - protein, 129 aa, Artificial
  Synthetic Construct
MAQAQTVHSYTVVSGFVDSLQEPRTPYISPSRLSKALGVKVANLAELTGVHRNTLRNPSSERLQGRMREMIKAISAAAELTGDLAKAIYWYRNEPIADYGHRTAAELVADGEIEAVLAYIRDLENGARG

SEQ ID NO: 84 - protein, 422 aa, Artificial
  Synthetic Construct
MKRISIKSVQPGDILLTARPGKISKSIRFSTGGIVSHAMICVQHGSFIDSTADGVQARNLQRELFEDDEQVFHFRLKEALPREVLSNVIDFARAEIGARYSVPEAMRSVAAVRKPRSKRQYCSRLVARVYRNAGINLVPDADYCSPEDLRRSRLLVEIPIETEAVSEEEWRWLETNRNPIRDTHQAHKAILDVARTFVPDLESLNELHALLVVRPEADPEIAEVLRESGYLDLWRGEIAAHPWRYDQSLIATMSAPEQMADIREYCIGTVSEAYSGGVRFSINLIQLQMLETQHGGQSLRLLVDLYETLVLNDQIRREVACAWLLKHYPDDLKKQLEQIEPHSAYWYSVVDRVEPKLAALSRMVVTAEGSSEVCSSCGDRPAMSYRLANGAQTMPGVPSLRLCSDCIEIRRGMGNILMPFLH

SEQ ID NO: 85 - protein, 317 aa, Artificial
  Synthetic Construct
MELLMPSSSQRTPPRESESARVKSDPASPNRNLPSDVLAKVATYVPTQDVVETARDLGNLERTGSAGREALRRGPIGIYHARVKRIGTSAKAVFDTIIPGEQLPDWQVNRPSETARTRAVGPLLKFQSEAGKARFTTNILNLPQPDQCDAILSVIKHLDDLGEVNKTRLIERSIEILQLDPPLTWNQGQKCPAADVLVQGEKHLNDDQKTRVQHERNNRPELLRLFRRAVADFEIEKNMAAHPRRYQDAKEPEVKPIDEVIDIIERYSRSVVTRGPNAIGLLTAHESFVKNVGDAYTRTRAEFDSSSRDRDRSALSR

SEQ ID NO: 86 - protein, 359 aa, Artificial
  Synthetic Construct
MFVRSDALSRIKPSATIVVSQKFRELKAEGRDVVRLNIGEPDFDTPDNIKTAAIDAINRGETKYTPVSGIPELRKAIASKFKRENGLEYSWEQTIVGTGGKQILFNAFMATLNPGDEVVIPAPYWVSYPEMVALCGGTPVFVSATQEHDFKLQPADLEKAITPKTKWFIFNSPSNPTGAAYTHAELKALTNVLMQHPHVWVLTDDMYEHLTYSDFKFVTPVEVEPSLYDRTLTMNGVSKAYAMTGWRRLCRRPAPAHQGHGHDPGAADLGCDVDRPVGGCRSAERHPGLHPGEQEDLRRPPRPRRLHAEPGQGHRLPGAGRRLLRLSVLRRPDRQDGAVGQGHRDGRGFRFRASGIGRR

SEQ ID NO: 87 - protein, 450 aa, Artificial
  Synthetic Construct
MRRRKRLSRKPAAAFSSFARIARKSVSSRGYFMNGRVSQKVSEESGPMISASIDPDNVSIADLDRFGHAIFKEWRPKRPFLRRQDGVYLVLRADDVLGLSSDPRTRQIETELMLNRGVNEGAVFDFVRYSMLFSNKETHSRRRSPFTRTFAFRMIENLRPQIRQLTEILFRDLKELGSFNFVGEYASKLPAVTIASLLGLPPSDIPYFTQLVYRVARCLSPSWRDADFPDIEKSAVEFKNYVQAVIDDRRTDPRDDFLSSYINATREAEDLSPVEGLTQLMLIILAGTDTTKTGLTALTGQLLQHRQAWDALLNDGTLVAAAVEEGLRFEPPVGSYPRSTLADIDLDGFILPKNSLLALCTMSALRDEKHYVHPQLFDIHRKQMRWHMVFGTGEHRCLGEALARLELQEGLATVLRHAPNLSIEGEWQAVQGHGGVRRIAEMRVGFNREN

SEQ ID NO: 88 - protein, 851 aa, Artificial
  Synthetic Construct
MIWDHLSPSRRVLLDIKSWSVLVLVIASISFAVLAIGSWQDNESNEAILTELQSIDVDCAMLQRNVLRAHAGLLRNYHPLIVPLGRLRTSVADLQQLFRRAGLDGAGEFSELLARVKSSVDATDAAVAAFGTQNVMFQDSLATFNQSIASLPRSLDTRDLNSLEVAELGYLMLQFSSQPNFEFAREINQRLDRLQVSANGDKAGVKEIVRSGRIILTLLPRLKDTVGVIQTSETIDNTKKLQRAYLEAYSLASAGEQRVRVFLGAVSVFFCFCIISLVHRLHLRTKVLTRRLDFEEVIKKIGLCFEDASEAKPSLESSTNAALGIIQLFFEAHQCALGLVNINENDVSVTFFGSTPAPEWNEQRVREIVSTVGAEDGGRIFRAYPQRKASCFGEDSPFLWVLLAFKVSDRIVAVFGLGFDREHLQTPTAREMQLMELAAACVSHYAVIRRKQSQRDILERRLKHAERLEAVGTLAGGIAHEFNNILGAVLGYAEMAHNVLRRRTHARDYIDHIISEGNRARLIVNQILALSRKRDRTTKPFDLSELVTVIAPSLRVALPPGVELDFKYQSAPMVIEGNSLEVEQILMNLCKNSAEACRELGRVEVSVRRSVVRKHKVLTNGTIPTGEYILLSVEDNGAGITEAVLSHIFEPFFTTRARSGGTGLGLSTVHGHVSAMAGYIDVVSTVGRGTRFDVYLPPSSKQPVNSESFFDPGRIPLGNGEIVAVVEPDLATLEMYEEKIAALGYEPVGFNTLDGLIDWVLEGKEPDLVLIDQPSLLDGDGAGSLISKLAKAPIIIIGENQKNVPLSADREGSARFLEKPISAKTLAYVVRANIRTERMVGSNSSEIVIAS

SEQ ID NO: 89 - protein, 240 aa, Artificial
  Synthetic Construct
MRKTAGSFGIIFLMVQPSKAAPLSFAEFNQLARECAPSVAPSTLGAIAKVESQFDPLVLHDNTTGETLHGKNPADATQSVNNRVAAGHSVDVGLMQVNSKNFANLGLTAGNAINPCVSLSAAADLLVRHYSGGDTVESEQLAIRRAISAYNTGNPTRGFANGYVRRVEVAAQLLVPPLAQSGKKGDRDERSPEEPWNVWGSYDRSHSAVGSSAPPEAQQPNERKSPEQDQVFEPNDGDAP

SEQ ID NO: 90 - protein, 108 aa, Artificial
  Synthetic Construct
MNADLEEATLYLAATRPALFFGVPLTLAGVFMMLAGFLIVVVQNPLYEIVLLPLWLGARLIVERDYNAASVVLLFLQTAGRSVDGHAWGGASVSPNPIRVASRGRGMT

SEQ ID NO: 91 - protein, 222 aa, Artificial
  Synthetic Construct
MNITKLVINALFICLVLSGTAKAQFVVSDPATEAETLTTAINTAANLEQLITMVTMLTSPFGVTGMLSAIDQKNQYPSAGQLDKEMFSPQMPASTTARAITLDADRAVVGDDAEGNLLRQQIAGAANAAGVAADNLDAMDKRLAANSETSGQLSRSRNIMQATVTNGLLLKQIHDAIIQNIQATSLLTMTTAQAGLHEAEEAATQRKEHQATALIFGAAQLH

SEQ ID NO: 92 - protein, 295 aa, Artificial
  Synthetic Construct
MNFSIPAPFTAIHTIFDLAFTVGLDTLLGDIQRAVSAPLVACVTLWIIVQGILVMRGEMDARGGITRVIMVSVVVALIVEQAEYHDYVVSVFEDTIPNFIQQFGISGLPLQTIPAQLDTMFSLTQVAFQKIASEIGPMNDQDILAFQGAQWIFYGTLWTAFGIYDAVGILTKVLLAIGPLMLVGYLFDRTRDMAAKWIGQLVTYGILLLLLNIVATIVVLTEATALVLMLGVITSAGTTAAKIIGLYELDMFFLTGDALIVALPAIAGNIGGSYWSGATQTAGSLNRHFARTIRR

SEQ ID NO: 93 - protein, 55 aa, Artificial
  Synthetic Construct
LKYFLLFLIIGLASCQTSDQLATCKGPIFPLNVGRWQPAQSDLQPTNAGEANERL

SEQ ID NO: 94 - protein, 292 aa, Artificial
  Synthetic Construct
MIKNLFLGLVCILFVTSGANAEDTPAAGKLDPRMRYLAYNPDEVVHLSTAVGATLVVTFGSNEAVTAVAVSNSKDLAALPRGNYLFFKASKVLQPQPVIVLTASDAGMRRYVFSLATRTMSRLDKEQPDLYYSVQFTYPADVAAARRKEAEQRDLADRMRAQAQYQRRAEDLLERPPAGGSTDAKNWSYVAQGDRSLLPLEVFDNGYSTTFRFPGNVRVPSIYVINPDGKEATANYSVKGDYVEVASVSREWRLRDGHTVLCIWNKAYDAVGRKPGTGTVRPDVVRVLKETR

SEQ ID NO: 95 - protein, 344 aa, Artificial
  Synthetic Construct
MEVNPQLRALLNPVLQWLDDPRTEEVAINGPGEAFVRQSGVFTRFAAPFSYDDLEDIAILAGALRKQDVGPRNPLCATELPGGERMQICLPPTVPSGTVSLTIRRPSNRVSELGEVSARYDVRRWNQWQIRTQRRDQLDEAILRDYDNGDLESFLRACVIGKRTMLLCGPTGSGKTTMSKTLISAIPREERLITIEDTLELVIPHENHVRLLYSKSGAGLGAVTAEQLLQASLRMRPDRILLGEMRDDAAWAYLSEVVSGHPGSISTIHGANPVQGFKKLFSLVKSSVQGACLEDRTLIDMLATAIDVIVPFRAYGDVYEVGEVWLAADARRRGETIGDLLNQQ

SEQ ID NO: 96 - protein, 229 aa, Artificial
  Synthetic Construct
MRHLITEYLTIHALRVTAVSDSQQFNRVLASETVDVVVVDLNLGREDGLEIVRSLATKSDVPIIIISGDRLEEADKVVALELGATDFIAKPFGTREFLARIRVALRVRPNVMRTKDRRSFCFAGWTLSLRQRRLVSAQNGEVKLTAGEFNLLVAFLEKPRDVLSREQLLIASRVREEEVYDRSIDVLILRLRRKLEQDAASPNLIKTARGAGYFFDADVDVSYGGLMAA

SEQ ID NO: 97 - protein, 119 aa, Artificial
  Synthetic Construct
SARLSYRVARPRICLMVEETLDQIALAIDPTAETEGLFSVGLGGDVCPAFALLGEVTDRVGVIGLVGKQCRSGPNVTQQLFGHRSIGGLTGGQCQSNRQTISIDERVDLCRQAATRTSH

SEQ ID NO: 98 - protein, 148 aa, Artificial
  Synthetic Construct
MSQSEKSTSSDIVDRREGPKIEGFKVVSTRLRSSEYESFSRQARLLGLSDSMAIRVAVRRIAGFLEIDAETRQMMEAILHSIGALSNNIAALLCAYAENPTTDLGALQAERNAFGKSFADLDGLLRSILSVSRRRIDGCSMLADALQH

SEQ ID NO: 99 - protein, 448 aa, Artificial
  Synthetic Construct
MPDRSQVIIRIVPGGGTKTLQQIINQLEYLSRKGKLELQRSARHLDTFVPPDEIRELALSWVQETGTYHESRPDEERQQELTTHIIVSFPAGTSQVAAYAASREWAAEMFGSGAGGGRYNYLTAFHIDRDHPHLHVVVNRRELLGHGWLKISRRHPQLNYDALRITMAEISLRHGVVLEATSRAERGISERPMTFAQYRRLERQQANQIRFEDIDFEEFSPGGNDGEPDQSFNSSYGSLPQNVSENLRRNGGLQSVSEVRSRALIGSNGNGVTPDRVSSGNDSRSQSGSDKAFVDDGNLRNGPLTIAGDGQDLEGRSGMHRLATEPVTHTTSEDDVRQRPHRKRPRGDEEEQSGAKLTRVDGIRTGVTISAVPVAQDDPITSPIQPPGSNPLDDPGQTNIATDALPPTADRRQQGEPNSKRPRDDDAEPSIRKRSRDGRSQGDEGNRR

SEQ ID NO: 100 - protein, 660 aa, Artificial
  Synthetic Construct
MNSGKYTPIGLAASIACSLAVGFCAASLYVTFRHGFTGETMMTFNVFAFLYETPPYLGYASPTFYRGLAIIVATSTLVLLCQLLLSMREREHHGTARWAGSGEMRHARYLRRYSHVTGPIFGKTCGPRWFGSYLSNGEQPHSLVVAPTRAGKGVGVVIPTLLTFKGSVIALDVKGELFELTSRARKSSGDAVFKFSPLDPERRTHCYNPVLDIAALPPERRFTETRRLAANLITAKGKGAEGFIDGARDLFVAGILSCIERGTPTIGAVYDLFAQPGEKYKLFAQLAEETQNKEAQRIFDNMAGNDTKILTSYTSVLGDGGLNLWADPLVKAATSTSDFSVYDLRRKRTCIYLCVSPNDLEVIAPLMRLLFQQVVSILQRSLPLGDERHEVLFLLDEFKHLGKLEAVETAITTIAGYKGRFMFIIQSLSALTGTYDEAGKQNFLSNTGVQVFMATADDETPNYISKAIGDYTFQARSTSYSQARMFDHNIQISDQGAPLLRAEQVRLLDDDYEIVLIKGQPPLKLRKVRYYSDFILKRIFESQHGSLPEPASLMLPGDTNLVEGKLDQGTADTTSQKPVQIEENDHGEVVSPQNRTVADGVMPIEVRPRSNEVDDEREYQGADAATSEKLPEIAPALLAQRELLDQIISLQLRGRTASGT

SEQ ID NO: 101 - protein, 309 aa, Artificial
  Synthetic Construct
MQERELSVLGGDKTESAATLPNDILVEVAKHLPTDDPVETAANLTSFKLASPSVRASVDQSDVGTFHRSVNRLGASSKALYDLAVPRNGFAEYPNYPEPDPAGEFALASQRIRTIGPTLKFQSPARKTAIVNHILNMSEGGEQAEAIMSMTSHLSDLERADKRRLIDRAIEYFKVDGPINYDSRHYAAYAIAAAHNQLELEHKSQIFDAMAKRPQLARLYADERIHAQEHLGLASTSEGPHERSNKQLATDILQIEQKIRTELLPETLSAHDQMVKAEGIAGSIEKAYRDARANLTRAPRGRSNSDLSR

SEQ ID NO: 102 - protein, 451 aa, Artificial
  Synthetic Construct
MVSINKKAPQKSSTATTRNSDERLVDQLGQAYLVEREAQERRARLEAPPALKKYASKLQLLNKLDADFRGVIAHKPFRSEQLRVDSNGELTHSRGLIKKKKKVFIRDQTTGSLRLIHYERSDWNSVRRYDYDQNGVLSEKHIKSKAGAFEEKWERDENGELMRTRYIDRRRLTGRALHPISEEIGRPYESGLEKRLYRVLTRREGSQQKTFERDDKGNLELIASKRMGYSMSSQKAPDRQTSRTSIRKLGGAFSESYRSRLDKDGHELGRDVSAHRSLLNKRSAVYDDATGELKSSKHTFGKIYKAEATYLNAEIKEVSKKILGVTVGKELKTLSGRELEAQVLRAAERALHKQAWQHPSANPSRSQRENTNSHLGNELDGPLESDMTVVHQAGSGFVGDDRHVHDGGGSRLNELHESRSSNDREKLSSPRAEICDRSMNRDRTGSGTLSR

SEQ ID NO: 103 - protein, 151 aa, Artificial
  Synthetic Construct
MITEKSVPSPKITATSVSSKPTCRVVRPGSTYAGKQGLNYFEGIAAETVGSTGICMHLLTIPPGARAKAHLHASHETAIYAISGETHCWFGDQLEEHVIVREDEMFYIPAGVPHLPANLSDRPATAVIARTDPKEQESVVLLPDLEGYVPR

SEQ ID NO: 104 - protein, 413 aa, Artificial
  Synthetic Construct
MNTTDYLNRSALYRKLLHGPYREFARVYAASMSKEGLGRQCTWRSLSLFRDLMDWHVGNGYAPQDLSEAYVDRFLEHRFKHWSPDTGDRSALRRVLSALREEGLIPGALPVERTEHEQIVDVFGAYLSNERGLAASTVGSYKLLSLRFLREVCPAGANGFAALTPEIVIGYVERHALDGSADSGKAMCGVVRALLRYLHLKGFISTALADCVPSIRRWRLAGLPTFLPPEKVQKVLDACDRTTAMGHRDYAVLMILAKLGLRASEVATLNLDDIDWQSGTILVHGKGRRQATMPLRHDVGTAIVAYIRHGRPASACRRVFLRTLAPHVGFASGCAITMIAKQALERAGIDGYAHHGAHLFRHSLATDLLRSGASFAEIGQLLRHRSIDSTRIYAKLDVDKLRGLSLPWPGGVQ

SEQ ID NO: 105 - DNA, 5718 bp, Artificial
  Right Flank through Left Flank, including tetracycline resistance gene of pRi2659(delta)tet, a disarmed pRi2659-derivative from Agrobacterium strain K599 (NCPPB 2659).
  misc_feature (1)..(2146): left T-DNA flanking region from pRi2659
  promoter (2248)..(2254): Tetracycline resistance gene promoter region
  misc_feature (2291)..(3481): Tetracycline resistance gene
  misc_feature (3639)..(5718): right T-DNA flanking region from pRi2659
cacgacaatcgctgtccttacaaactatgctgcccgacgcgatgcacaccttggcacgccgcgcagtccctatttcttcgtcgccgaacagggcggcagattgctgcatcaatacgtgcaccgggtgttctggcgactatcccggcaaattggtttacggcaggagggggatcgcggtggcccgcgggttcacgatcttcgtcaccgtttcgccgtccaaaccctgatcaactggcatcgcgctggcgaagatgtggaacgcgagctgccggtactctcgaccttcctcggccatgccaatgttcgcgacacctactggtatctgtccgccgcgccggagctgatgaatcatgccgttcggcgattggataagcggtgggaggttcggtcatgagacgaacgaacgacttagccgtgctgatcgagcggtggttcacagatcggctcatgaagcatcgaggtgtaagttccaacaccattgcctcctatcgagacacgttcaggctcctgtttgcgttcgcgcaggcgcgccttgggaggtccccatctcaattgacactgcgggatttggacgctccgttcatcggcgcattcctggaagtcctcgagacgcagagagccgcctcggtgaggacccggaatctccgcctcacagccattcgatctttcttccgatatgcggcgttcgaggagccggcacatagcgcccacatccagcgcgtgctcgcgatccccagcaagcgatgcgacaagcggcagcttcagttcctaaccaggcccgagattgaatcgatcctggactgcacggatcgaagcacgtggctgggacgccgcgattacactctgctattgctggccgcgcaaacggggctgcgggtttcggaagtcatcgacctcgaccgagactcggtaatgctcggccgcggtgcgcatgtgcaatgcgtcggtaagggccgcaaagagcgaagtacgccgctcacaaaggttgcacaggaagccctccggcgttggctcaaggaaccagggaagcgaggcgcaacggctctctttccgaatatgcacggtggcaggctcagcgccgacggcgtgcaggcactgctgaacaaatatgtcgccaaagcgcgcgagcactgcgtctccctccgctcgaagcgggtgtcgccccacgtcttgcggcacagcgctgccatggagctactacaggcgggcgtcgactgctcggtcattgccctgtggctgggccatgaggcgatggaaacgacgctgacctatcttcatgcacatcttgaactgaaggaatcgacactcgcaaagctgaagccgtacgaacgcgccaaggccgagcgatttcgaccaaacgaccggcttctggaattcctgaacgccctctgagcatgagaactatgccgagtgccaacgacgggtcttcgaccaaaacggcaagagaagcgcgtttcaactggtaagttggaagaggtgctcggcatagttcgccggtcggcataaaccgccttatgccgcgcgcggcataatgctgtcatgatcagtgtcgccatgaaggcggcgcgatcggcacctcgatccgatccggcgaagagccatgacttcctcccgagagcaaagcctctcagcgctcgttcggccgcgttgttcgtgagacaaatcctgccctcgtcgaggaaagacgtgaagccgttccagcgcttcagcatgtagtcgatcggctcggcgactggagaactgcgcgacagttttgcccgttcggtttgaagccagcagtgcagttcgccgacaagcggcaggctgtccttgcgacggcgctccaggcgttccgctgcggcaagcccgttgatctgccgctcgatgtcgaacagggcatcgatccgtttgacggcctccaacgccataggcgagatcggtgcggcgcggctgccgcgtttggcattcgtggcgatgtcggccagcacgaagaacttgcgcctcgcgtgcgaccagcagagcgcctgcgtcagcggccccggatcgcgggtctaccttgaacagcggattgtagccgccaatatgttctgccgaacatatcgggggctatgttgcggccgtccatatgtggccctgctgacctataccctttgtcaactgagtatttgggcccggatctatcgatgcatgccatggtacccgggagctcgaattcgcgtcaattctcatgtttgacagcttatcatcgataagctagctttaatgcggtagtttatcacagttaaattgctaacgcagtcaggcaccgtgtatgaaatctaacaatgcgctcatcgtcatcctcggcaccgtcaccctggatgctgtaggcataggcttggttatgccggtactgccgggcctcttgcgggatatcgtccattccgacagcatcgccagtcactatggcgtgctgctagcgctatatgcgttgatgcaatttctatgcgcacccgttctcggagcactgtccgaccgctttggccgccgcccagtcctgctcgcttcgctacttggagccactatcgactacgcgatcatggcgaccacacccgtcctgtggattctctacgccggacgcatcgtggccggcatcaccggcgccacaggtgcggttgctggcgcctatatcgccgacatcaccgatggggaagatcgggctcgccacttcgggctcatgagcgcttgtttcggcgtgggtatggtggcaggccccgtggccgggggactgttgggcgccatctccttacatgcaccattccttgcggcggcggtgctcaacggcctcaacctactactgggctgcttcctaatgcaggagtcgcataagggagagcgccgaccgatgcccttgagagccttcaacccagtcagctccttccggtgggcgcggggcatgactatcgtcgccgcacttatgactgtcttgtttatcatgcaactcgtaggacaggtgccggcagcgctctgggtcattttcggcgaggaccgctttcgctggagcgcgacgatgatcggcctgtcgcttgcggtattcggaatcttgcacgccctcgctcaagccttcgtcactggtcccgccaccaaacgtttcggcgagaagcaggccattatcgccggcatggcggccgacgcgctgggctacgtcttgctggcgttcgcgacgcgaggctggatggccttccccattatgattcttctcgcttccggcggcatcgggatgcccgcgttgcaggccatgctgtccaggcaggtagatgacgaccatcagggacagcttcaaggatcgctcgcggctcttaccagcctaacttcgatcactggaccgctgatcgtcacggcgatttatgccgcctcggcgagcacatggaacgggttggcatggattgtaggcgccgccctataccttgtctgcctccccgcgttgcgtcgcggtgcatggagccgggccacctcgacctgaatggaagccggcggcacctcgctaacggattcaccactccaagaattggagccaatcaattcttgcggagaactgtgaatgcgcaaaccaacccttgatcaagctgacgcgaattcgaagcttctgcagacgcgtcgacgtcatatggatccaattcctttaagctctcgatgccccggtcggtgaaggtcgtgacgccctcttggctgccgtcatgggcatggatcatctcgccgtaatcgatattgtctgagttgctggcgatttcctggaggagttcgaggttctcgccgatcagcgaagcaacataatcgatcgtgtagacatgcgtcgggcgcgctgaccttgccccgttgtgagccgctaagcgcattgtcctcaccaccagctcatgtgctgtaacgcgcgaagctgtcgcaggctgtaccctctataagttaaggtacaactctgccgttggatgaattagcctcctgaaacgcttcctttacgtggctgatcaaagcacgttcagtctcgttaagcggcgtggaggtggagaatattgcccatagtcgccgcggcgggactaaatggtcgagagagaacgtgtccacgatccctgcctcgatctccttgatcatcaccgacgctggcaagatcgtgccaagaggtgaacgacgcaaaaccgagacgatcagaggtaccgaacccaaccgcattaccggctcgagctgcacagtagacttcgcaagtgccgtcagaagagtttgatgcattgtgagctgtgaaggtgccagaaggagcgggatgctcctcagctcgtctgccgaaactctctcggcctgaggcgcaaaattcagcttcctattgacgatcaggacgacgtcttcgctgcggccaattagtagagagcctacttgcggatcgatcctaccaacgacagcaatattgaaacggccggttagaacgccatgatgcagtacatgtcgagggccctccacaacctcgatttggcagttcggaaaattcattgtgaaatgcgctaagcgccacggccatgcattcggacgtcaaggaatctgcgctccaactcaccggtaacgcaatccgaattgattgttcaaaggccgcagctatgtggcttcgttcgcccagagtgtcgttgaaagccctctcaacgccgacaaacagcgaatgcagcctttcagcatcatcggtcggttcagaaccggtcttcttccggtcgataagccttgtcccgagcgcatattcgatctgttcaagctgggccggtatcatcggagcagtccgtccggcgacgcgggcagcgctcgccatgctgccggtctgcaccacacgattcacggtagaaatctgcttcaggctaaccttgggatggaaattcgtggcttcggaccagcccgaaggggcctcgacgcctttgcggacatcatttagcagatttaacagaagttcatggtcgttagagagctctgcggtcacgcagcacgacggactgcgaattaccggaaccgcagtgatgccctggatgcgaagacgctggggtacagtcagttggggcagaagtagatccgacttgcggatgtcgtcgatgagccctcggagatcctgcagacttcgatcggtggtggaaatccgtgatgtcgcgataccgctggagcggtcgaatttcgtgtcgctttgcagtgtacccggcagatcgggaatttcggtttttggagcaatgtcaccacgctcgggtcgctccccaaccgtatgggtcagcctcgtccaatggtctggagcaacgacaacagaaggtccggataccccagtaccgatggtatgttggatcttgagctgcccgagtggcaccgcgtctgacagaagatggctgggaccgttctgcattccgaaggcgccagtacccgtgaagatcaagtctacataagggtggtcgggtttggaatggaagcggcggatcgccgtgattacagcgtaggaaattgctgtccaggtatagtcaacgtctaatttgaggatgacgggcgccgaaggcgccgcgctgccgccaagtttggcatgactcaaatattcctcggcaaggaggagacgaacactgcgattgtacagccagaccgccgagcgtagcggaaaggagttacgccctttgcgaccaaaaagcgtcactccaatctgggcttcgagcgtgctgagcttggcatctcaatgccgatggtgtgagaccaagcttc

SEQ ID NO: 106 - DNA, 202303 bp, Agrobacterium strain K599 (NCPPB 2659)
  misc_feature (1)..(2146): Agrobacterium strain K599 left T-DNA flanking sequence
  misc_feature (376)..(1392): rcorf148, similar to mll6374 integrase/recombinase from Mesorhizobium loti MAFF303099
  misc_feature (2254)..(2700): complement of rcorf2b, similar to riorf2 in pRi1724 which is strongly similar to a Rhizobium sp. pNGR234a nucleotide sequence.
  misc_feature (3515)..(3734): left T-DNA border from Agrobacterium strain K599.
  misc_feature (3613)..(3636): left T-DNA border repeat from Agrobacterium strain K599.
  misc_feature (4727)..(5551): complement of CDS1 from pRi2659 T-DNA, similar to riorf11 in pRi1724, COG0561: Cof; Predicted hydrolases of the HAD superfamily [General function prediction only].
  misc_feature (4727)..(5551): CDS2 from pRi2659 T-DNA, similar to riorf12 in pRi1724, homologous to orf3n of pRiA4.
  misc_feature (7477)..(9819): CDS4 from pRi2659 T-DNA, probable tryptophan 2-monooxygenase (EC 1.13.12.3), homolog of iaaM and tms1, similar to riorf13 in pRi1724 and to orf8 in pRi8196.
  misc_feature (10619)..(10900): CDS5 from pRi2659 T-DNA, probable rolA, similar to riorf14 in pRi1724.
  misc_feature (11357)..(12196): complement of CDS6 from pRi2659 T-DNA, probable rolB, similar to riorf15 in pRi1724 and to orf11 in pRi8196.
  misc_feature (13315)..(13857): CDS7 from pRi2659 T-DNA, probable rolC, similar to riorf16 in pRi1724 and to orf12 in pRi8196.
  misc_feature (14553)..(15149): CDS8 from pRi2659 T-DNA, probable rol gene, similar to riorf17 in pRi1724 and to orf13 in pRi8196.
  misc_feature (15614)..(15886): complement of CDS9 from pRi2659 T-DNA, probable rol gene, similar to riorf18 in pRi1724.
  misc_feature (16496)..(17062): CDS10 from pRi2659 T-DNA, probable rol gene, similar to riorf19 in pRi1724.
  misc_feature (17371)..(18162): complement of cus gene from pRi2659 T-DNA, probable cucumbopine synthase
  misc_feature (18557)..(18747): right T-DNA border from Agrobacterium strain K599
  misc_feature (18571)..(18594): right T-DNA border repeat from Agrobacterium strain K599
  misc_feature (18598)..(18739): 8 bp repeats of overdrive equivalent from Agrobacterium strain K599
  misc_feature (18969)..(21040): right T-DNA flanking region from Agrobacterium strain K599
gcatgccacgacaatcgctgtccttacaaactatgctgcccgacgcgatgcacacgcggccgcatgccgcgcagtccctatttcttcgtcgccgaacagggcggcagattgctgcatcaatacgtgcaccgggtgttctggcgactatcccggcaaattggtttacggcaggagggggatcgcggtggcccgcgggttcacgatcttcgtcaccgtttcgccgtccaaaccctgatcaactggcatcgcgctggcgaagatgtggaacgcgagctgccggtactctcgaccttcctcggccatgccaatgttcgcgacacctactggtatctgtccgccgcgccggagctgatgaatcatgccgttcggcgattggataagcggtgggaggttcggtcatgagacgaacgaacgacttagccgtgctgatcgagcggtggttcacagatcggctcatgaagcatcgaggtgtaagttccaacaccattgcctcctatcgagacacgttcaggctcctgtttgcgttcgcgcaggcgcgccttgggaggtccccatctcaattgacactgcgggatttggacgctccgttcatcggcgcattcctggaagtcctcgagacgcagagagccgcctcggtgaggacccggaatctccgcctcacagccattcgatctttcttccgatatgcggcgttcgaggagccggcacatagcgcccacatccagcgcgtgctcgcgatccccagcaagcgatgcgacaagcggcagcttcagttcctaaccaggcccgagattgaatcgatcctggactgcacggatcgaagcacgtggctgggacgccgcgattacactctgctattgctggccgcgcaaacggggctgcgggtttcggaagtcatcgacctcgaccgagactcggtaatgctcggccgcggtgcgcatgtgcaatgcgtcggtaagggccgcaaagagcgaagtacgccgctcacaaaggttgcacaggaagccctccggcgttggctcaaggaaccagggaagcgaggcgcaacggctctctttccgaatatgcacggtggcaggctcagcgccgacggcgtgcaggcactggttttcgctgctgtctatcgggcgcgcgagcactgcgtctccctccgctcgaagcgggtgtcgccccacgtcttgcggcacagcgctgccatggagctactacaggcgggcgtcgactgctcggtcattgccctgtggctgggccatgaggcgatggaaacgacgctgacctatcttcatgcacatcttgaactgaaggaatcgacactcgcaaagctgaagccgtacgaacgcgccaaggccgagcgatttcgaccaaacgaccggcttctggaattcctgaacgccctctgagcatgagaactatgccgagtgccaacgacgggtcttcgaccaaaaacggcaagagaagcgcgtttcaactggtaagttggaagaggtgctcggcatagttcgccggtcggcataaaccgccttatgccgcgcgcggcataatgctgtcatgatcagtgtcgccatgaaggcggcgcgatcggcacctcgatccgatccggcgaagagccatgacttcctcccgagagcaaagcctctcagcgctcgttcggccgcgttgttcgtgagacaaatcctgccctcgtcgaggaaagacgtgaagccgttccagcgcttcagcatgtagtcgatcggctcggcgactggagaactgcgcgacagttttgcccgttcggtttgaagccagcagtgcagttcgccgacaagcggcaggctgtccttgcgacggcgctccaggcgttccgctgcggcaagcccgttgatctgccgctcgatgtcgaacagggcatcgatccgtttgacggcctccaacgccataggcgagatcggtgcggcgcggctgccgcgtttggcattcgtggcgatgtcggccagcacgaagaacttgcgcctcgcgtgcgaccagcagagcgcctgcgtcagcggccccggatcgcggtctaccttgaacagcggattgtagccgccaatatgttctgccgaacatatcgggggcttgttgcggccgtccatatgtggccctgctgacctataccctttgtcaactgagtatttgggcccgatttgacgcaacataaatcgcaagtttggcagccggaccttttctcgtttggaggttcgacatggatcacccttccttttccgaccaagccgctgatgccctatttaccgaagtgccatttgctgacgagcggaaccgctatttgcatcactgcgccacactcggagcgagacccgaagttctcagggtcaaacgcaacgaactcctgtggatcgcgcgacatctcggtccagaggctgcggccggcgtcggcatggcggagttgttgccgatcgcgcaggctcggcagaatgttcacggtgcggctaccgctgcacgtcgggtcgtcgatatcgggcgcccctggctgaagttccttggctggtggcgtgagcccactgtcatattgtcgtaccaggcgcaactcgaccggtatgttggctggatgcgcgacgaacgcggattgacatccgtcgacggtggaacaatgggggcgcatagccggcagattcttgctgtggtgcgaacagtcgagccaccggctcaaggatttgaaggcagaagacatcgacaactatatagcgacccaaggggccggacgctggggtcgtgtctcgattgcatacatcgtctcagccttgcgcggatttcttcgatatgcggcaaaagaggcttggtgctcagaccgcctggtgtcgtcaatatcgcggcctcggctctatcgacaagaatctctgccatatgccccagactggtcggacgtccaaaagatgttggctgatgtcgataccgaccggccccgcgatatccgagaccgcgcgatcctaatgttgctggcggtatatggtatgcggcgcggcgaagtagccgcgctgcggctcgaccaaatcgactgggcggggcgaacgcttcggcttttccgcttaaagcgccgacaagccccagatctatccgctggtgccctccgttgcggaagcattggcacgctacgtggacagagtccgcccgccgtcgtcgtgccgagaggttttcctccggatgcaggcgcctcgacatcccttaggggcctccagcatttatagcgtcgccaatcggcgatttgttgcgctcaactttatggaccgcctcttaagggcggtggagcgtcgtgaccggaagaagttgaccgacgtgcaagccgtcagcggttgcgcaaacgacgatgatatccgtctccagcgcagtgtcttggcccaatgcctgattttatacagccgagttcaataagcgaagtggcgcacactgtcatcagaactttcctgccaaccgcccgaggtctccaaacgaacaaaaccgccttacaacgggccttgcttcaagatattaccgaaacgtgctccctcatgaaaaggtcgcgaataggttgcggctatcatcgctcttgatcatggcgcacctcataagcgacccaaggcaaagcacgatgtcgccttatgtggggtggcaggatatattgtggtgtaaacgagctaagtacaagagctttgaagcgatttttgagcacgtttttgctatattaccagatggtgtccgggtatgtttaaaagtgattaatacagcctatctaattacaatttttatttaagatattaaaataataataatatccgcgcctttaaataataaaggtgaaaattttatcgccaatcgtcgtcgtgcaacaatacgtgagcctgcacttattttccaaattatataaataggaaatacaagcagattggagcaattagaaagggcgccaataatattcactactaacattttataaaaagaacaaatacatctgtcgactatgccgtacgagttggtcgggcaaagcggagactcgccacaagttgaagtcgtgagaggcgatgggcacatcgtcagagctgagtgcggcatcgagctcggaaagattgcgcctgcctatctctccgagagcagcgagcaacgacgtttcagtgcattcctgtactcgctttccgagattgtacatgcctctgtgttcgatgacttgaagaggcagagtctcttcaagacgttcaaggaggttcggtaccgagtgccgggcgagacctcatccgccgtgacaccatttgggagatcccattcgagcttccactcgggccaacatgtgcctttcacggggaacggtttgcgctggcaaaggatatcgttttccatcggtttcggaaggctgccagataaatatgagcttttctaaaaaggattcttgtaataattaatccttatccggcgggagtcttaagtacttaatgatgttgaaagaatttatattaaaaatattctattctgaattattgattaattaaataaagtatataaaatataaataattttcggtgaaaaagattccatagttatttattcaataatgcagtggctcatggagatattatattatttctggcgttgtgtattgaaatagtcgccggagtggcggatcatagacactaaaatagaaaaaactaagtaacaactgaagcaattatgacttctttcccttcctacggtgactatggatgtaatagaacagcggcagatcggagcgatcacttgctcagatcgggcaacaacacgccgagatcgccaagaattgcagagagagcatcctcattcggtatggcgaagacgttggttccagtgggcttcgtctcacgggtaccgacccagaacgcgataccattctccttgttgccaacagcggtcagcatatctttatcgttttcgccgttgccgcacgctatatgtaggccgatctcacgagggagtagattgacataagcaaaatagcctttgcgcttgcctggcgtttcctcgggcataacgcaatgaccctcgggtactgcggtcgcccggaaagagcgtccccaggaatgatctacacgcggaagaagcgatgaaagcagatctccggccgattggtaacgtggatgagagtcccacatctgacagccatagaaatgctccatcggaatgttgcggatttctgggttgccgccaaattcgctctccataaccgcatgaatgcggctccagttgggcaggggaacggattcaaaacgttgacctttgaagattgtgaccgttccgtcattcccttgaaaatcaatacctggaatgtctttgaagggcgacgagccgatttcgccgcagtggcgagcggacgtcagcagtaggtaatgtcccttccgggcgatcttggtcaaattgtcgatgatatcgatggcaggagtaatttcccagcactgaggctttcgatcttgcttaaaggcggtgccatcaccatcgaaggcgagcagaacccggagagagggatccgtaagaccgcgtgctacccgttccgcgatatccggaatgacctcaacaagagacatattcaaagctggtgtaaatacgatctgaatgaagccttaaatgtaacgcagcgcggcaagcattagttgactttttggtgagagaaataactcttagcagggattagttggccagccattatcaatgtggggccaggctgacaatgtttgcgtgcaaggccggattatgtcgatgtagacctgcagacccgttgacttcctataaacaccgccaatcatccacctctccctttccaaggtcttgccttttttgccttgctaccatgccagccagcgacgcgatgtgcgctgccgcggtcgccttcccggagggtaactggaagagagaactcgctgcgctgcagattttgcatgatcctgtagatgtgattacggccgctgtcgccagaggtcttagcggcatatgtaatgtcgttgctgcaatggatgccgaaaaagtgacaggcctcggcgacgtcattcggcggatgcctgctctaaatcaccgaattgccgtcgccgccggtgaaactccagtgcgagacctcggaatagggtaccagtgcgcaatctgccaccccgacatagcaagtgctatgttagccacttccgacgggatcagccatgctgtccgtgaaaagatcgagaaagaagttgctcaggatattggagaaggtgccatcgtatacatcttcattcagccgaggatgagttccagcaactctccggtttctgtccatttcaccctccagtttgcgagttctggagctctcgtcgaagccagaatgatagagagttacaattttatgaaaggcgatggcacagtgactgcagagaaattgaaaagtcattggaagcagcacggtattcgcagaccaagtccacgtccgcccaggtccaaatttgaacttcttttcgctccggtccccgacaacagtaaacttgccgccgccgatttcacccatctcggcttggtcgagcgggatagagaattgcttggcagtacggtcttcggaattgccgccaataaacctgggacggtagtttatcagtgtgacaaggttctgtgtctggaagtggatgtcgagtcacaccgcgcgttggaggtgcttcaccgccttggggagcaggtatatagggctggttggggcacgagtttcggtcttcacacaggcccttcatcttgtcttaatctttccgctgctgcactcgccacctttttcaaacggactgatctttgttccgtccctgctgagtgatgttttttgtctcttctgcgaccatgccagccgttcgtacgccgccaaagaagacggacttccactcaccgccttctccctcgaaaatgaaagtcagtttgaactcgtcgacccccaggttgtcagaaaatacgttctcggtcttttcgacgccccgacaatggttgagccccgcgatatcagcagagcgagcttctgcagccaatatataactttccgggaaccacatccctgtaaggagttcaatgaaattggtgttctgatcctcgatgctgctgctaaaatgctcgaaagttatgccgaattcctggaagacgatggaagcgatgataatgaaattgcgagcgttaaagatgtatttggcttaattgataggacattatgagcacgatacaaaacagaagcagtaacggaagtttccaatgtgtttgatatttgtgttgccattgtatgttgaattccttttgtcaatcttattgcatgttcgaaattgcataaatttgggccgtaattttccgacttttttgaattttcgttcatctctttaattgttgatgttgtctagggagacagctttattgaatttcaatgacatgtcgccatttacgtgtacatcagaataaaaagataattccggcaaatagtttcaatttatatatattacatccagatttacattaacaaagcatgccttctataaacaaaaggaaattctatattctctcaatactccatatctacatgatggatcttccctataaccgcccccgtttccccccgtttgctatcaccggtctacctagtgcggccaaactgaaacgagcaatttctcgggcctttgtctgctatgaccagttttgcgatgaactcctacaatatcagcaaaggtggacggattgggtgttcgaccacggatttgcagaagccatagaagacatggctctggtgttccagattgaaccttgccttcatggtccccgaacaggcacactggaagtgctgagatcttgtcgcacgaaggtcttcatttatacgtcgtaccgcaggttgcgccactttgttgagaaccagtgcattgctcaacctggcgacgccgtccttgcttgcatgatcccgccctacgtgagtgacctctcactgcaggaaatgtctcgagcccacaatagtttttgtccaggcagtcacacgagcattgcagacgtgcagtgctttattgccatccaactcagcagcctatttgttgaggagggtacatgtgatgtgcatgggcgaaatggattaaaaacaacctgccgcttctttcgtcgtcccgctgagtgcttcagccgttacgacatagttgcaatagggtctgtgctctttcacaacgcattgcatcagccagcgaactacaatgaggatctttcttgcttcgatctgcggtacgactatcaggttttcctccatgagcgcgatgccaatgatggtgtggggcattatccggaaggcacaccactacctagtgtcgccatcgtaggtggtgggctctctggccttgttgctgctgcagaactacttgacgctggcgtcagggaaatagccctttttaccccagtagatgaggttcggagtttgggtgtatcgccgatgtcaaacggcgacgctcgccaggtcttgacgtcattcggtgtcatgcccatctccggcaaccaagtttgtctgtcatactatctggataagtttagaattccgtccagccttcgttttccttgtgccggcaacgatcacacagcactctacttccggaaaaaacgttacgaatggccggctggacaagctccaccaggtgaattccagcggatatctgcagggtgggagaaactactataccacgggtgtgaacggaacggcaggaggctgatcgctccgatggatatcttttccatgctgagaggtcggcgttatgaagaagcctcggaagcaaggcgggcttggctcagggagtttgataatttcactttccatgccgctctggtcgagatcttcagctgcggtgtcgagagtcctggtggggcggcatggcaaacaactgattttgctgctttcgggatgatgagattgggcggcggccgagtttcttcctgttacaccctactgttttcgacagtcctggactggataatcaatgggtacgaggaggaccagtatatctctgttggaggggttcatcttttgcaggctctgatgcgcattgagatattcaagagaaaagtaggattccattttgaccccctgcgtggactagccaaggagggcgggaaagtgaaggtatgcatgaaagatggccgttcgcgcgtttttgaccaggtcatcattggcgggcgaggtgggcccgatgcaactaatatcactccggttagccatgtgacctgtgtcggctatgatatcgaagcccccgctggaaactcgtctgctactgttaacgcagcacttttcatgatcacaaagcaaaaattctggcttgatgacgatatcccagctttgatctggacggatgggctcgtccgtgagctctgttgtattgacatcgaatcgccatcgggagaggggcttgttatttttcattatgaaatgaacgactatctatcccgcccgttccagtccgatgagaagaagagaaggtgcttggatttagtcagagaacttgctgctgtctttcctgaattggcttgtcatttggttccagtcaacgaagattacgaagaatatgtcttcgacggccacttgaaggatggtttcagggcctctttatggagggaaaattctcttaaaaaatgtcagtacagccaagatccgcatatgtatgattctccgttaatggagcatggggcagtttgccagattgacagtaaggactgcgtaaacggagctttgttcgaagagcaggttaagacgggcatcataacggcctgcaccgtcattcgcagcaccggcgggacactatcttcactccatcccctggattggaataaaatatattttcctgcttaagtatattaatgtattagtgcgtattaatcccgtaagcctgtaagctgcagtagcggcgctcaacttagctttccatgaataataatgtttttcctttatttttgattgaatcctgcttaaaaaatattctttgagtgggcttaaaatgacattaatcagattccaaaaatttccatctgtgaccattagcgccttgatcgatgacattaaagtcttcacatctccagagaaagccttcgtgattgcttgtctccacgtgctttcgcatcttgacagctaatagcgggccccttgacacactagccggccacgcaattcgagatattcccactaaccccaatgaggtcactgcattcgtcattggcagccgccccacttgcattcgccactgtgccgtttggggtccactagccgctaattaggactgcatatattttggacgagctaaggggtcactatcaccttcggtttgaatttccttttcacaagactttaatgttgccaattgagcaggctgaaagaaaatccgcaatcaacggagaaaggttaacagccaaacaaaaaaagaatgcttcatcattgcatagggtctacaacgaccattactttcggcggtgggccttctactatttttttcttagtcttcggccagccatttgttaacttcctatatagatcgcttcaccagaagaatgaattatttagatcatgctgtaatgcttcaatgctgtaagttctaaatgtttgtttcgttttgcaagaaatctattttgctaacagcacttcttttattctcaggatggaactagccggaataaacgttgtcggaatggcccagacctttggagaggcctcgctcgttgtctccgacctatttcggcgggctaaggtcaagaagaagaaggccaaacgtgtgtcgccgggcgatttcctccctgaccaaattgcagagcttgatgatctgagcgtcactcctctggctataacttctcctgggcctcccgtgatggtcaatgatcacggaattgccacgaggggacgctttgtcgctggaccggaatattcagacctacggggttaatacgcagttctaaacaaacctacgggaattaatacgcacgtggctctataatttcgattcatctcgccgccggagatgatgtcggctattttctcgttggtacaataagttgcgagccaccgtgcgattgtttttaattttctatatagtactttaacgtctctctatggcgatttgtaatgtttggaatattattgtctgttaaggcgcctttgtaacaatatcaatgtaaaagcattatcagtattgtgtgagatctctataaatatcgaaatgatttgcctattttctgaaaattggcggcagaaataatgctgtaataatttatttcaacacaagtaaaatacatcgtggcgtacgctacacaactcctaacaggagcatagggctacgccggaaaacatagaaatcctaccaaacttatagttaaaggtggcctgcaggggacctcaagtcgccgaggtttctttcttcagatttactatagcaggcttcatatcaccctcttcacgtttctggttgggtcccgagagccgcagggtgaggtctggctccggtgacggtaccgccggtcgtggcatcacgccagcatttttggtgaactgtgtgatgccgcaagcaatgacgtcataggagcggtttccagtgccttgccgcacgaagaaggtgcaggctacctccctgccgtacacatttgtcacttttaactccagcaggtgaatgaacaaggtacttgcaaaaatggcgataaaaccttccagatcaggttcttccacgcggcggtgcggccaagcaatgttgtgagcacggaccatctcctggagggcgaggtcgctacgatagggttgcatcgtggtcgccagcacggcctctaatccaaacgtgatggatttttcctccagtactttctgcatcttctcgcgagatagatagacaaatacatgtcggtcgttttctctggccaaatccggttgatcgacaagcatggggggatgataacatactttgttttttagaacgatgggccagttgtttaagtatgaccaccggcgacggttttcctccaaatcaagcacgccttgggcccaccttttctggaaatccatgagagttttgctatagacttggctatagattaaaaatgcaaattggatctcattgaacaagttaagctggttccaggcttttgtgagatctcgtggttgaaagcgttgaaggaatagtaatcgaggaggcattgtgatgtgaggttggggataactgtggaataacggcaagttcagtgccatttaaagtacgccgccggcaagtggcatcaatcagccacagtttccggtcgggaaagccagaggcaatctggcaataatcaccatcgcatcaaaatcgatgctcggacatggcggccttaaaacctggatcaagcgaaaaataatgcctgcttgattggtcacgaggtcatagtagtgggctagcatttttgtcttttttgtttggctttagtgaaagtgtatctaaaagatacctgaaatggggaggggtggggtagagcttaaagtttgccgaatattggctttcgtgaaagctgcacgggcaacttgttgatggttgcactctcgatgctatttataattaagatgtaattattgccgctacgtgtagttattgccgataatatcataaattctattgatgtatgtggtatattttgaaattgcatatgtctgctcatacaaataatttatttcaattacgcaattactcttatgccaataaaatgtggattatatagcaagtgtaatcttaaatacaatttggacctatacgacttaatattgccacgccaggcaaccagtccattcggatcttgctataagtgccatactgatacaagttttagatttgaagcccatcaatcgttttagagcccaaaaatcaaaatgggccgaaatagcatttatctaaaagaaggaatcgtggctagttaagtgctttgaatgagatcccatggaaaagcgacacctgtgtggtgcagacaggcctaacgtggtgcacaggttgaaaaagtagtgccttttcgcagcataaataaaggtaggcgcgtgcgaccataattaaaggaaaaagaaagatgctattgacgatgtgacaccattattggacagcagaacctattcccactcgtgcttttgcaaagatgcaaaacccttaaaggccattttaagtacagacacgtgccggtctataattattttacaaatgtgagacgtggaacatcgatagtcgtataatttatgaatattgggttttgcagctatacctaactgatattcaactcatataagcaaaagcatctataaagggaatggtgcttccagttctgggtgcacgccactattgtttcctactttgctaacatggcggaatttgacctatgtgctctcttttccagtcttaaggtaggcgacgtatcgtccagcgatgagctaaagaaacacatccagagcgcctcaaaggagcggacccccctgacggagccgggtgagggccagtcgatggatgttgacgaagagggcggtcgccaagaccctgggatactgtacctctacgtcgattgcccgacgatgatgcgatgcttttatggagggtctttgccctacaattccacgcacggcgcgctcatcaccaatcttccaccataccagaaagatgtaagtctcggtgaggtgtgcagggggcttaggcaggcatcaggattctttggatacgaggatgttatccggagcgcctacttcgccgcactttctgtccccgggtacttcgtcaagctggatgggcagatggaactaacttcaacaaagggaaagtctctgaccttcgacctttatgccagcaaccagctcaggctcgaacctggtgcgttggtgaggcatggcgaatgcaaatttggaatggagtgatggcagtagctgttctgacggtgcccagaggctggaggtggtacctgtttcacgctagaaatataaatgtaataaactcatggatctggttgatgtaacctgcgccatggatgcacttgttcttttttggttccgatggatgggttgtttgcttgaaatgaaacctgcctgttcgaaatttggttatcactttttccatttatgtttttaattatttgtgtattaaagaaaatagttcacatagccgcaatatatgaccgaagctggcccgcaatgccgcaatagatgattaatttgtcaaacttagctatcaatatctcgatagaagtgcccacatgtttaaactaggcaaactcgttctccttgaaaactgataataaagacaagaaaattagcccactctaaaaagtcacatagcaaattcaacataaagaaaccagaagtcagaggaaagacttttaatccttgattatttgaacgaaatagccgcaatacgccaaagtgtcgccttcatgattgttcaataatttctgtagcaaatggaaaacgttttacaaacaatgtggccttggagtaataatcggaagaaaagttcataagtcagataatttgcgttgctgacactagtgaccaagcacctttaaatacctctgcttcccatgcatttttccaagttaacctaaagtggcagttgaatggctcgttatttcggtggtagctctcaacggcttcatgtcgatgattttcgtttgatcaaggagcccactcgactgaaggctcagcttgttaatgtggtggaaacctacaaggctgcacaaacagagacgttaaagtactatataccatctgcaactgagcgtgtggctcatatggaggcagtccatgtcaacaatgcagaaatggggctgcatccggccgggttcaagtatcctctgtccttcgtctttacctccctggccgtggctaaagcctgcaaggagaacaagcatctcgtgtgcgaggagcatttggagggagatctgatatcgtgcgtcgttcctccctatcagacaaatgtctcactcgctgctttaagggagatccacaattccatttcgggaggagggtaccggaatccaacagacatggattattttgtggcgatcttgccagatgaaaatttcgactatcagagctgtgaaattgtcaccaaaaatggcggcgaaggcctttgcaagatttatagcagacaactggaggggcccttagcttatgaggccatactggcaattggcaaggtcctgttggaataggcagtgcaccgctgatccaacgggagtttcgattatatttcgtattatcttacatgacttaagatcatgcatgtttcgcttgttctcccgtgtgtcggttacgttattgtgttaaaataacgggatgatgatatcaagtgctattgtaaaatatgttatattttgaatatctataatataagcgctgtgtgcgctcgatgggtagttaaatgatcatgatatatatttttgggtaatcaatcgcattgcagtgccgtgtgcttattgaagtaatatagtgttaaaattatttatttaatatctgataacatatcaaagggtacaacgtgataacaaagacggtggatacagcgtttattgggatatccgctggccagttatacgtaaataatacagacagagtttgagagagcacgcagattgtagccaagttgagtgacttgccggtagcaccgaagctaagctcaggtgttccaaattgactggcgtcgaggtgacgagcacgacgaccttgccggacaatgcggtcgcagggggctcaaggcgggtggcttgtaacggaccttgtgcttcttgttgtagctttcgttgagcataaccattgggaaggttgctgaacaacggtagcgcacctttttcaagcgagggtggcagaagaacatatttgcccgtcggcagacggcggtgagcatgacagctgctaagggagttactggaatcgcgtgagcggtgagcatgccgtcctgactatcggcgcccaatcaacaggacatcctcaacatgttttccaattccttgaaacctatctttatagcattgatctccaaccgatctcgattgaggccaaatttaatattcaaaagagagtttagtggaaatggaatataatcccgtggcggaagaagagccttcaaaaatggcagtccactaggacagtcaataatatccaaaaagcattgaaattgggttgggcacgagaggctgacgcggatgccactcgattgctaatggagtggttccttttctagcatatcgaatccatcgcttcactatatccttacctgattggctgagctgcgagaccaccaataacttccactaatatcgaaagtgtggctgctttgattatgatgctttgtgagaggttctctccccaataaagtcaagttgacagattcggatacgcccggttgagattttatttcattttttatctatttcgcatctcgaaaagttcacagaaatcaacaaggaggaggccaggtgtttaaataggttccagctgctctaaagtgatcagaagagaatttacagctggaggcacaaagcactaatcctgctaaagcatgagcatggcagatgagttggagcgtcaattggaaggcatttctctcgttacagtcctgggtccggatgtgagggccgagcttgaggcggcgctacgggactaccgcgatgatctcgacttctggaaaaggaacggttacgcggtggcggatctcgatcaatctgtgacggtcgacaagcttctttttatgtatatggatgaaccaatagcagacttgtgtgtaaagaatcgcatcctcgtttgcaacagcaattcagtcgcgaaaattacttcgcttccaccatacctgcctggggttacaagggccgaggcgtttgagaaacttaactccattgtttgtggaggtcctgcatctggatctcttcaatctgcttgttgcgactatttcgtggcgttcctccccagcaattgttttgagaagaccggtgagatatcggtgcgcacagtggacggcgagtgtggccccttcgatgtctttacccggcagcgtcagccagaggatcagagcgatatgttttttaagtatgaagagattgtatgtgctggaaagagtctatttttttgaaactagtgtgttttatctgtgtaacatgttatggagtctgatcgtatgatgtaatagctaaatttggtattaataatgattgatcgttatataagaattgttattaacataattaagtttagagtaaagcaagagggaaataaattaaaacactttattcagttacaaacaattatgaaaatacaaacataatacaaacataatacaaacgtcgcaggagaaagatgacaccgtaggatatttatgagccaaggatagacttgccagaaggcgagatcgtcctcatagcttagtgccttgggcgggccctaactggtgggctccatcttgagaaaaaacagctccttagtcaggaaggtggcttccagaacagcgcgaccaaccttatagatatcgtcggcatactccggcaggatctcaccgagaaccggtgtcgcaatatcttcggtgacttcaccatactggacgatgaccttgttgccggtgccctgggaatagcggatacggccgaccggagcatcgcactgccgttccttgacgttaacctttgcggtgctcacgacaggcgcccacgcgtacatggattcaccgctgacaacggcatggtcctgaacaaccgtgaagggcagagcttgaataaggtcgttgcagagttcggggttttccgttcgtcgcgagataggcaatgacgctgatgcccagcggctcccaggtaagccgtaccttttgaccgtcgcggatctgaacacgccgagagggatcggccagggccgcgatggaacttccggggtctcgtaagtgagatgttttccgatgctccaagggaagtaatggaatgaccaggcggccaaacggttgaggtaacccaggaacgccttgacggcctcaaccgcctcgtcgcggctaccagccgtcggaagatatttggtgatcgcttcggcaaaagcgcccatttcctgcaagccgctgtagcgcagatagttgctgtatgcgtagtcaaagcggtgcacgagtgcgcagcactgctcgagggtaaatcgctcatcctggaacgtcagcagcaacggataccacgtgtacatcgactggtcgcgcagcatgccgttcacgaagtcgaggttcgtgaagtattggttgtttgtcccgaccgcgaaggtgccggtccggatatcatgaagctccttcggtctcgatatggaggattgcctttgttgaaagcgtgatctctgcaacgagctgtcggaggtcgggagcgacttgcctgcaggccatgtgttatgaacaagaaggtggaagcaaatagatgatgttaggaaagggtgggattgcagggtgggcaggcacgatacttatagtggaaaaaggtatggagcaatttcgccgaaatctgggtgggccttctaaatattgggcgggccgcaccgtaactataattgcaggggcccaccaggttaattgcgtggccgcgttgattgggtgatattattacctaacatgagattgttatttgacaggatatatccccttgtctagttcgtcagttcgtcagttcgtcagttcgtcagttcgtcagttcgtcagttcgtcagttcgtcagttcgtcagttcgtcagttcgtcagttcgtcagttcgtcagttcgtcagttcgtcagttcgtcagttcgtcagttcattaacattgctccgcgcttgcctgatttgagaggttgtctctgcacgggtctgcagcgacatatggctacgaggacctaccttgccgatgagccgtatccatccggcgtagggcggggtttatgatctcggctcgtctgccatgatgcgttcgatcctttcgggatcacattgctcatcgacgcggaattgccggacaccgccctcgcaggtgcggataccggcgaggaattcctttaagctctcgatgccccggtcggtgaaggtcgtgacgccctcttggctgccgtcatgggcatggatcatctcgccgtaatcgatattgtctgagttgctggcgatttcctggaggagttcgaggttctcgccgatcagcgaagcaacataatcgatcgtgtagacatgcgtcgggcgcgctgaccttgccccgttgtgagccgctaagcgcattgtcctcaccaccagctcatgtgctgtaacgcgcgaagctgtcgcaggctgtaccctctataagttaaggtacaactctgccgttggatgaattagcctcctgaaacgcttcctttacgtggctgatcaaagcacgttcagtctcgttaagcggcgtggaggtggagaatattgcccatagtcgccgcggcgggactaaatggtcgagagagaacgtgtccacgatccctgcctcgatctccttgatcatcaccgacgctggcaagatcgtgccaagaggtgaacgacgcaaaaccgagacgatcagaggtaccgaacccaaccgcattaccggctcgagctgcacagtagacttcgcaagtgccgtcagaagagtttgatgcattgtgagctgtgaaggtgccagaaggagcgggatgctcctcagctcgtctgccgaaactctctcggcctgaggcgcaaaattcagcttcctattgacgatcaggacgacgtcttcgctgcggccaattagtagagagcctacttgcggatcgatcctaccaacgacagcaatattgaaacggccggttagaacgccatgatgcagtacatgtcgagggccctccacaacctcgatttggcagttcggaaattcattgtgaaatgcgctaagcgccacggccatgcattcggacgtcaaggaatctgcgctccaactcaccggtaacgcaatccgaattgattgttcaaaggccgcagctatgtggcttcgttcgcccagagtgtcgttgaaagccctctcaacgccgacaaacagcgaatgcagcctttcagcatcatcggtcggttcagaaccggtcttcttccggtcgataagccttgtcccgagcgcatattcgatctgttcaagctgggccggtatcatcggagcagtccgtccggcgacgcgggcagcgctcgccatgctgccggtctgcaccacacgattcacggtagaaatctgcttcaggctaaccttgggatggaaattcgtggcttcggaccagcccgaaggggcctcgacgcctttgcggacatcatttagcagatttaacagaagttcatggtcgttagagagctctgcggtcacgcagcacgacggactgcgaattaccggaaccgcagtgatgccctggatgcgaagacgctggggtacagtcagttggggcagaagtagatccgacttgcggatgtcgtcgatgagccctcggagatcctgcagacttcgatcggtggtggaaatccgtgatgtcgcgataccgctggagcggtcgaatttcgtgtcgctttgcagtgtacccggcagatcgggaatttcggtttttggagcaatgtcaccacgctcgggtcgctccccaaccgtatgggtcagcctcgtccaatggtctggagcaacgacaacagaaggtccggataccccagtaccgatggtatgttggatcttgagctgcccgagtggcaccgcgtctgacagaagatggctgggaccgttctgcattccgaaggcgccagtacccgtgaagatcaagtctacataagggtggtcgggtttggaatggaagcggcggatcgccgtgattacagcgtaggaaattgctgtccaggtatagtcaacgtctaatttgaggatgacgggcgccgaaggcgccgcgctgccgccaagtttggcatgactcaaatattcctcggcaaggaggagacgaacactgcgattgtacagccagaccgccgagcgtagcggaaaggagttacgccctttgcgaccaaaaagcgtcactccaatctgggcttcgagcgtgctgagcttggcactcaatgccgccgttaattaaccaagcttcgcggccgcatgcgccatcgttggactgtcgcaactgacaacgaaagctgccagatgcggaaagtcgatcttgggcatactaacctcggatgaatgtgcgcatcagaaccttgcgcgagctctggagaccctatgctgaaaagatatcggacaaccgggttgccttgtccagatcacggatcgcccaaacatgctttccgaaatcggccaccctcgactgccttgcgcgggaaatgcctcccgccagtttcctggtgatttcctcccatccggctggatcgtcgggcgcccctcgcggcacacgccgccgctcggccagtcgctttccgtccaggaagaccacttcgatgtcggggttgtccgaatcctcactccgcgcgaacatcgccaccttgaccaatagctcggaaacgtcctcatgtgcgatggcgttcgtttcaaaatcgttcagcgttaactcgccttggagcagggcggtcgccaccgtatagttcatgctgaacttcgcctcgattcccgttctcggcttcggaaagcgcagatagcggatgcactcgtcgcggacgaaacagttgatccgttcgatcgctttgatgtcgaaaccagacagcgctcggatcgtcaatgcgccatcaattgcaagatgggtgcagaccagcccgggccgtcgaccacgcgtgccctatagtaacaagttcccaagggttgccgagagctggcaacgttgctgctgatccgcctgtgaatgcatccaggaaaccggatggtgcctcaaggatgccagatccggccgtgaagtcgctttctgccagctttgcagcaaggaagccagcttgagcggcccggccgcaatgcaaactcttcgtcatcgttccggtgttgccaaggatgcccccggcaaaggagcacgcgatcgcgagtgcgtgctccgtttggcgcgcgtcgaggccacgcaagttggccgcagcgccggcagctgcgagagtcccgagcgtcgacatcgtatgccacccttggcgcgtatgtgcgctgcccactgcgatgccaagcttgcaggcgatctcgatcccgactgcataggaccgcaggaatgcccggccgctcgcttgcgtttcgaaggccgtcggcagcagcgcactgacgatcggggcactcggatggccattcatcgagaactcgctcgtatcatcaaagtcgtctgcatgcgcgcaggtgccggtcagaagagccgccagtgcaggatcgctccagcaacctagaccagggacgggaatgccctcccgatcgttccctggtgcgcatactgcaacgagaatttctacaggccgagacgccgtgccagcatatatgcaagcgagtgtgtcggccacatggatctttgcgcgctcggacacagactgaggcacttcccgcacatgggcgatgaagtcggaaagctcggctgttatggacatgacaatgttcggacttgtgcgccttggaaatgaagaaaacaggccatgtcttgggcacctagcggagacgccggccgtaattcgccaactgtttaggagattcgctccaggaattcggccgtgcgagcgttttgggggcgaccaaaaaatctgctctggtggcccctgttcaatgatggagcccttatccatcacaacgactcggtcggccacctctcgtgcgaaacccatttcgtgagtgacgacgatcatggtcatgcccttgccggcgagttctttcatgacagagagaacttcgccgaccatttccggatcaagtgcgctggtcggctcgtcaaaaagaacaatctcgggcttcatcgcgagaacgcgagcaattgctacacgctgctgctggccacccgagagttgcgcgggatactgatctcgcttatcggccaatccgacgcgctccagcagggcaattccttcctggatcgcctcttgcctcgggcgctttagaacatgaacgggagcctcgatgatgttctgcagagcggtcagatgcggaaatagattgaagcgctggaaaaccatgccaacattcctgcggattgcggccttttccttctcgctgagtgggacctttttaccgcctgcgagcttgttgctcacaagtgcgccattcaggtagatctcaccgctctggatttgctccagatgattgatacaacggataagcgtcgttttgccggagccggacggaccgatgacgacaacggtctccttaggttggaccgtcattgaaacattcttgaacacgctcagggtaccgaacgacttgcttacgccgcggagttccacggcaggtgccacgctggctttggattgatcggccatttcaggtttccatctgtaacaggttgggggcgttcgactcgggctcgcgcgcagcagtgcgaggactccaggacagccggttctcgatccattgttgaaggacggtccacaccccggtcagcacgagatagtagacggagatcgccgcataaacttcgaaggtcttgaagttttgcgatcgcaggctgtcggcgacgtgtacgagttctggaacggcgatgacgctcaggaacgcagtggtcttgaacatcatgttgcattggtttccgagcgaggggaggatgatgcgaagcgcctgggggaggatgatccggcgcatcgccaacgacggcaacatgcccaatgcctgtgcggcctcgctttgtcctttctcgaccgatcggatgccggcccgcgtgatctcgctcatatatgctgcttcgtgcaagctgaatgcgaatatgccagcgacaatcgctccgctgatggaaaacgccggcgtcgtgattgtcgacgggaagatgtcaacaccgatcaggtagggcagcccaaaatagattagaaacaactgcacgaggataggagttcctcggaagaaccagacgtaaagccagttgaaacctctaagcgcgccatacaggctcagtccgaatagtgccaggaacagtcccgcaatgatcccgaccgccattgatgtgagagtgacggagacggtgagccagacagcatatataagctgcggtggtggcgagaaaaccagctcgaggaaatagtgcaggtcaaagttcatgattgagctcccggagcaacttcgccgccttcatgagaccgagtggcgttcgagcgactacgctcgccgaattgggtgcggaccaggtcatatcgaaacgaagccctttgaataacgcttctccaatgcttcttggagaaagctccaagcggttgtgagcgcgaggtagtagatcgatacgccgagatagacctcgaaggttttgtaggtcactgaattcactgcgtcggtgataaacagcatctctggaaccgcgatcaggtacagcaacgatgtcgccttgaacatgccgttcatctgattgccaagtggaggcaacatgatgcgaattgcctgtggcagaatgatccgctgcatgagaagccccggcgtcatgccgacggccctgccggcatcccactggccatggtcgaccgaagcgatagcgccgcgagaaatttcgctgaagtatgccgcctcatggagcgcgaaggcggtcacccccgcgacaatcgccccgctgatcgaaatgaagccgaacagatgcacgtcctgcggaaaaagatcgacattcgtcagataggggaggccgaaatagatcagaatgacctgcacaaggagcggtgtgccgcgaaacacgaagatgtaggcgctgttgaaccagcggagcacgcgccatcgtgatagtccgaacagggacaagacaagccccaacaccacaccgatgaccatggacgcgaacgcgaccagaaccgtcgtgagcagaccgcgcagaagggcgggccggggattgaagacaaaatccaggaaaaaggcgatatcgaactgcatgtcgataatgtccccgtttcttattgtgttcgagttccgttgccgaggaccttacctcttgcgcggagggctgccgccgaagcggcaggccaggagtgtacacctactcgaacctatcgagcgttgggcatctgcggaaaatcatgggcactgcttgtcgttgcggcaaagctcgacatggccgtccatgccccaggtcttggcggcctgctcgacatagccgctttcgtagagagagacataagccttgcgtacggcttcttgcagcgcagggtcgtccttgcgaagcacaataccgatggtgagggggtcgatcggtagaccgccgatctcatatttatcgccggtgagcttcttgaagtaggagagtgtcatcgcgtcgctcacgaaagcgtccacacgtttcagatcgagctgccggaacgtgaccgtattctgcggataggactggatctcgatcggtggcttgccttcggcgctgaccttggtgttggcttccttcagtaggcgttcgttggtgctcgagaccagaaccgcgacgcggtgtcctgaaagatcctcgtaagtcttgatattgagggggtttcctttcgggacaaggaggcccatccgctcgcgcacgtactccacgaaattgtattttgcgacgcgagctagacttttcgaattgttcgacatgactgcatcgcatttacccgtgtccaaagcagcgaagatactggcgaacggatagtggacgacttcggttttgatacccatcgccgggccaatcgccgacattacgtcaacattgaagcctttcggcgtgacgccgtcttcatccaggaagccgccggggggattgccgagttcggtgcacatgacaatcttgccggccttcgccagtttttcggttggctcgacgctcttcgtgattcccgaagccgcctggctgttttcatatgctttgccttcggatggctccgccgcctttgctgccggtgcgatacagactccggcaagaagtagattcacgatcaatgcgtaagaacgaattctcattgtattcccctttcttcttcacgatgttagatcgttttcactacgcgggacgcatctcctgtgatcgagaattacgtccaggtgttttggtttcggcaatgggcgatggtcgctggctattctccgctgttgttgtcatggacgcaccgctaagctgtcattgctgcaaaagccggttttcctccgcgagtgcattcgggattaaatcgagcgtcgctcttttgctttccttgatgaagcgcgaaaccgtattgcgtacgagggttgctctgaccgaagcgtcataatcaaaagaacggacggccagggcagcccggacgtcgatgggccagatggcgtcgaacgcctgtcgcgtttcacaatgcgagaatcggttgttgcccttgatcatggccgacctggctgcctcagtggccttcatatcgatcgtgaagtcatcgcgaattaccaccccgtaggccgcgcgagcttttttcagctgagacgacgccccgctttacgtccgcgagcacaagctcgggatctctctctgacgctggcccaaacccgccccccgccggagtgatcaggcggacgacgtcaccccgcttgaagtggagaacgtcaatcttgccgatctcacgttcatccttcgtgtcggggttgacgatgacgcgcgcgagggatccggcttcgccgcccatgataccccatggagtgaatttgagccgatccatgccgcgcaccgtcatgacggcctcaacgtcggtgttctccagatccaggaccaccgaggcgccgctgcgccaacgacccggtgcctggctgtcgatgacaaggccgtatcgttgaacgcgcatgatagtttcgacttcgatagtctccgccggcacggtcaaaagtgagcccgaccggttgtcgacgccatcgataccgtcgtgtcctattttaccgccaccgccgccgcaaattggattgatcacgctcacacgcttgccgccatgaagacggtcgcgtccggtgaccacgatgatccccgacatacccgggccagctgcggccagtcctccggggattgcggcgttcaagcaaccaagcacaacgtcgtagacgcgggtcgacgcggtgacgcgtgatccgccggcggctgggaagttcgcattgatgatcgttccgcggggagcgatgatcttgaccggccgcagaaggccacggttccggggagcgtctggcgcctttgtcaggatatagtagattagcgattgcagggtatagggatgtgtggtcgagccagtgacatagttgaaggctgcgaggacctgaggatccgttccggtaaaatcaaacagtaaatcgctgccggtgaccgtcatcttcgcatggatattgatgaattcaccggccttcataccctcaatgtagtcggcgaactcgtaaattccgtcgggaatttcggcgataacctcccgggccctcgcttctgatagggcgagcgttgcatccatcccgtcgatgacttcctgcgtcgaataccgatcacagagttggccgagacgcacatccatgctcttcatagcagagaacattgcttggatatcgccccacagctccgatgagatgcggctgttatcgagcaaaatgtttctgacggcctcgttgagaactccctcgcgatacagaagcacggggcggagcctcagcccctcctgaaatgtttccgtaagtgtcggcgctatgcttccgggaaccgcgccgccgatgtctgaggcatgcacgaaggcccatgccagcgctatgagccggccgtcgcggaagatcggatgcaccagcgacacatccatcatatgggtgaccatgccgtcgcttgagaatggatcattggttatgatgcagtctccaggcttcagggaggaaattgggatatcaccgagaccgcccttgaccgacagtccgatgaaggcgctgacaccggtatttacggggtaggcgaatgcttcaccctcagcatttgccaatgcgcactggaaatcctgaacgagcttcacgaaggttgtgtgagccgtacgctgaagggtcgaggatgcttcttcgacgatcgcgttgaaccggttcgccatgattgcagtttgtacgggatccatttttactgcctccgcgtcagtgcgagtgcgccggttgcgagggcgctcgcgtgaaatgctgctggtacgaggacggtagaatcgtcctcctcgatgacgcacggccccttgaccgtgctgccgacagtcaggtccttgcgccgataggtgctggcggaaggatggagctttccggcaatgcggatgtcgcgctgcccaacgggcgcaatttcagcacgaggcccaagtggagcgtgctcgtctggaggcataggcagactgccccggacacgcacgcgcagttcaacgaactccactggcgcagccgtgtcgcaatggctgtaaagccgcagatgctcatcatggaaacgattggcaatagacgtaagatcgggaaatctgccatgactgacaggcactgcgaccgcgacttggaatgactgtcccctatatctcagctcggcccagaactcgtgttccaccgaaaccagtcgggatccgtcgatctggttcgataaccagaccagggtctcatccttgagcttttcgaattccgccgccacgagttcgtcggtgacggtcgaaccctggatcaccgcaatgacatcgtgtgtaagtgaagtcacgaccccgccccgagcgcagaagaccgagggagcgggcggcacgatgatcgaattgatgccgacctcatcggccagaagcggaccatgtagcgcaccattgccgccgaatagcacgagggtgacgttttgcgggtcgaggccatgggcggcaagatagggcagaatgcggcttaccatattggaggtagtcaccgacaagcacgcgtcagccgcttcggcagtcgagacgccgagctgctgcgccacggaggagtaagcagaagcggcgcgatcgacatcgaggcgcatcgcgcccccgaggaaattctcggcgttcagataaccgcacaggaggtaggcatccgtaaccgtcggcatgtcgccgccgcgggcaaatgcagccggtccaggaaaagcgccggcactctccggaccgactcgcaatgcaggaccattcaaccgcaccagagaaccgccgccggcgccgatcgcttcaatttcggtaacgggcagggtgatcgggaaatcgccgaccgcgccttgtgccgttaccgttggttggccctggcggaccaaagagacgtccgtacttgtgccgcccatgtcgaaggtcagcatatattcatgcttattggtgctggcgatggtttgggcggcggtgatgccggaagcaggaccggacaatagggtatgcaccggaaagttcatggcgtcggcgaggccaagcgcgccgccgtttgaccgtgtcacgtagaggcgcgccgaagtcaggcgcgagttcacatactgctcaatgtcgtggagataggactttacacgcggcttgacgtagacgttcagggttgcgttgaccgcacgctcgtattcgcccatgcgaggccagatgtcgctcgatatgcagacatcgatttcaggtgccgccgccgtgatgatgtcgcggacctttcgctcatgtgtaggatcgcggaagctgtgcaggaggactactgctatggaggacacaccttcggcgcgaaccgcggctacggccttcctgactgcgccttcgtctaccacggtcaacacctcggcatccgcgctcaatcgttcgggaacctcgaagaccaggtttctgggcaccagcggcagggcgcgcgatgaaaagagatcgatcgggttcttcagacgcagtcgctgcagctcaaggatgtccctgaagccttccgttacgaatagcgctaccggttcagccgagcgttcgatcacagtgttcgtgctgaccgtcgttccgtgcatgacgatgacttcgtcgccatcctcaacctcaagcgcctccagtagcggctcgaaaccgttttggaaaccctgtgcgaaattcggtggagtagagggcaccttcaggcgcttgatcccttttccggaatccgctcgccatcctacgaagtcggtgaaggtgccaccaatatccacgccaatcctaaccagtgccatcgaatatttcccatttcctcacttgtctgaaggcaaaacgatacctgcatggcccgtggggccacgtcggcaagtcatctgcattcagcgtttgatgagctatcttgagacagagcatcagagttgcgtagtgcagttttattaaattgggtgcatagtttttttgaagtggatgccgcctcggattcttggcggcacttcttgtcacaaaaaacagcgccacagggcgctgcttgttccttatcgttcgaagtcgccgcttatggaccgacgggaagcgtattcggtttgaagcggacgacgaaccggtgacggtcgccagggtagatcaggcgcacgaatgtgattaagtcgccctccagccaagtccggcgcgcaatcgaaatgcaggccgtgcgctcgaccacctgtagcctcctcgccaggatcgtatcagccgacacggcgcggattgaatgctcgccttcagtaaaagggatgttctgaagcagccagcttccaggcggttcgtctttgaactgttggcgttcggcctgtggaacggcgtcaagattgatctgccgcgtttccattgtgaacggaagattgtcggcatagtgcataacttcgagggttaggagccgtgtgccaaccgggactcctacatgccgcgcatcgagcgcgtcggtggcctttcggatgctgcgatcggtaatctcgaacgtataggtcctgtcgattgccagcacttctgcgcggatatcctgaatatgcatcagcggctcttcaatacgcggcggcgcgacgaaggagccggagcggcgctttctcgaaatcatgcccgaggctgcaaggctcgacagggccttgttcaccgtcatgcgggaacaattgtaaatatcaaccaactcgcgctcaggcgggatgcggaagccggagccccactcgccagtggctatcttgttttcgatgtcacgctgaatctccagataacgcgacgacgcctgtttgtctgtcgcgacttcatccattgctggtcgattcattgttaaggaagcgagcatcagtcaccagtcgtacctctttcacctgtattacaaaccttttattggtctataacatatggtgctttggccgtataccaaccgtgctcatcgcaacagctcaataaactttctgaacgtcgggaagggaacgcagggagccgccccttcccggcttattcagtcgaatattagagcaacggcaaaacatccttcgaaacgggcgttgccaggcggccggtcgcaacgagctccgtcgcgcgcttgaggtcttcggccatgtatcggtcgtcttcgagtttcggcacggcggtgcgaataaccttgcgaactgcatcgagctccgaactggaggtgagtggcgttctcaagtcaataccctgggctgcgctcagcgcctcgatgcccacaatcgaaaagagattgtcggtcatctgcaggagacgccgcgcgccatggcaggccatcgacacgtggtcttcctggttagccgaggtaggggtcgagtcgacagatgccggatgcgacatctgcttgttctctgacatcagcgcggccgaggttacctccgcgatcatgaaacccgagttgaggcccggcttcggcgtaagaaacgccggcaggccatagctcaggaccggatcgacaagcagcgcaatgcggcgctgagcgatcgcgccgatctcgcagacggcgattgcaatctggtccgccgcaaatgctactggctcggcgtggaagttgccaccggatacgatcgtgccgtcggacaggacgagcgggttgtccgtcgcggcattggcttcgatcatcaacgtggcggcggcttgacgtagcagatcgaggcaggcgccggcgacctgaggctggcagcgaaggcaatacggatcttgtacccgctcatccccctcttcatggctagcgcggatttcggaacccgccaacagcctgctcagcgcgctggccacgtcgatctggccctggtggccgcgcagggtgtggatttctggatggaacggcgcagtggaacccattgcggcgtccgtcgatagcgcgccggaaatgagggatgaaatgagagctcggtgggcgcgaaagaggccggccaatgccagcgccgtcgaggtttgggtgccattgatcatggcaagaccttctttggccttcaagacgataggggtgaggcccgcctttgccaatgcctctttggctggcatgacctcaccgtcgaacttcgcctgaccttcgccgatcagcgccgcagtcatatgggcgagcggagcaaggtcaccggaggctccgaccgaacctttctccggaataatagggagaacattcttttcgagcatcgcggagagaacgtttatgacctgtggtcgcacacctgatgcacccctgccgagcgagatcaacttcagcgtcatgatgaggcgaacgataccgtccgggagtggcgctccaaccccacagcaatgtgacaggatcagattgcgctggagggtttcaacgtcgtcggcgggaatgcgcacactcgccagtttgccgaaaccggtattgatgccgtagtgagcgatatctcccccagcgatctcggcgaccttgtcggcggatatctgcactctcttcagcgccgcggcatcgatcacgggtgcgagcgtgccatcataaacggcagccagggtttccaatgagacttttccgggaacgagcgcgtgggccatgtttagaaccttttagggggacaggagatccagaggcatacataatagccatgcgtcctctattttgtatataccaatacgaaaatggaccaaatgtaaagcgccgcgcagcaaaaatacgaacagcggctctaaagaggtgccgctctaatgccgtcgtggtggcaacggattgattatgttcactgaaccggattgaaacgaccgtgaaactcttgcccgttgacggctcgcccgtagaacattcctagataccacgggaagtaatggtaggaccacgcgcataggcgattgccatacataatgaaggtgcggagcagtgttttgagttcttccttgtcgtccgtctgcttcatcgccatacgaagtttgttcgagaaatccagcagcgtgttaagaccggaatagccgagatactccgaatacgcgggatcgaatgcttcaacggcggccacaaagtcgtcgtgcgagagcgtatcgataagtttgaggagcgggtaggcggtgtacatgatatagtcgcggagcatgccgttggcgaagtcccaggcagtgaaaaactgaccgtaggtcccggtatcgccgatctgtcccgttcggatcttacgcagatcctccggctctaccgtctggatgcgcttggcttcggcgtagaactcggctgcgacgcccttgaggtttccgaagcggccctgtccattgaaggcttccgcgggatcgtgtggccttacctctacgaagatcctctccttcgcgaagaacagattgttccagatggctttgccgacgatgggaagcagatggtggtattccggacgtacctgtcccagcaccggctgcgccaggggctcaaggcccttgccatactgaatggaaaacttattgccggtcgcctgggagtatctcagatccccaacggcacaatcgacgatccgccgacgcagccgcaccggcgcggtgctgatcgtcggcgtccaagcatataaggactcgccggaaacgacgggatgagcctgcatcaccttgaatggcaggtcctgccaaaattcctcgcacaattcagggttatcatcatccgccaattcagccacgaccgtgatctgaagttccggccacgcgatatcgatcaatcttcccattttcagcgcgctccgaagaaaaattcgagccagtgagaccgcgccccgaataggtatataccatagaggttgctcggctggtcgcaacgacgaaatcgccttaatcggcgctgagcgaaagaaaattcccatacaaaaaggcgtatttgtctatttttgtgcaattttggaatgatgttagaggaatatttcagtttccggatcgaggcgcggtcgttttctggcccgtcaagccgttagtttttgggctaaacgtatattttcctaagcggtatgccggacgaaaatattaaatggtctatacaaaacggagtttatggctatgctaatccgagtggaggtcacctgccacgcacaagatcaaccataggattctgagaaatgtcgtttaacagcttgagtgacgtcgttaaggcggtgaaggaaaagacggctgcttatgaaagcaccgagccgaaggagcttcatgatatccggaccggcaccttcgcggtcgggacaaacaaccaatacttcacgaacctcgacttcgtgaacggcatgctgcgcgaccagtcgatgtacacgtggtatccgttgctgctgacgttccaggatgagcgatttaccctcgagcagtgctgcgcactcgtgcaccgctttgactacgcatacagcaactatctgcgctacagcggcttgcaggaaatgggcgcttttgccgaagcgatcaccaaatatcttccgacggctggtagccgcgacgaggcggttgaggccgtcaaggcgttcctgggttacctcaaccgtttggccgcctggtcattccattacttcccttggagcatcggaaaacatctcacttacgagaccccggaaggttccatcgcggccctggccgatccctctcggcgtgttcagatccgcgacggtcaaaaggtacggcttacctgggagccgctgggcatcagcgtcattgcctatctcgcgacgaaggaaaaccccgaactctgcaacgaccttattcaagctctgcccttcacggttgttcaggaccatgccgttgtcagcggtgaatccatgtacgcgtgggcgcctgtcgtgagcaccgcaaaggttaacgtcaaggaacggcagtgcgatgctccggtcggccgtatccgctattcccagggcaccggcaacaaggtcatcgtccagtatggtgaagtcaccgaagatattgcgacaccggttctcggtgagatcctgccggagtatgccgacgatatctataaggttggtcgcgctgttctggaaagcaactttggcgacaagaagccgatcatgctcacgatcgaactcgcataacaagcgttcagccggggcggtttctaacgcgagccgcctccctttggcgacaaaaaaattgacttgattggctaagcctttctgttaatatgtatagaccaaaccgcaggaaacatgcggtaacaggagaacggcgaaatggcattctggtttgaattcgacaaaatcagtgaccttccgaacaatgcgggacacagcgtcctggatgacggaagttcgttctgtttcagccatgtaaccgacttgacgacgcgtttctttaggggcggattggcgtggctatctggcatgcaactgccaaacatatcgccccgatgacgctgagccttagctcctccgaggacagatcccagcggaaaagaagcggcatttgtatatgagatgatgagcctcaagcaacggaggcaaatctcaaacctgaagtcaactcaatgtttgcggtagggcacggtgtccgacgcagaacggtttgtctcgcgttgctgcgagccaaaccccaaccaaggggaactaaccatgaaatggcaatttgggaaagccatcgtcggtggcgcaatgttggtcgcagcttgcgcgctgagttcaggagctcaggcgcaacaaaaggagctgatcgtcagcggttttggcggtgcctatgacgaagcaatggctgcgagcgtgaaatccttcgaacaggaaaacgacgtcaaggtcaccattgttgccgggtccggcgcgaacaacatagcccgtgtccgcaacaaggaagtcgacgttatcgtttctgatccggttttcgcgcttcgcatggaagccgagaaggcgtttgcgccgctcgatccgaagctggttaccaacctgaaggacattcacccgaatgcgatctactccgacgcggtcgtcgcagcgaatttcggcgcatatgtgctcgcttacaatcctgcggaggtgaagccgccgcaatcgtggcatgatctcgcgaagccggaatacaagggccgcatcgcgctgcgcggattccggcctgaaaatatcgatctaatcactctctttgcgaaagaggccggcggcgacgagcgtcatcccgacgccggcttcgccgaaatggccaagatcgctcagaacatcgacgtctgggtggactcgcacgccaaccatctcgaactgtatcgcaacgaccagatctccatgagcatgtggaccgatggccgcatcggctgggcgcgtgacactgaaggcgtaaaaatccagggcgtcattccgaaggaaggatttttcccgctcgcctcgacgcttagcgtcgttgccggacgtccgaacaccgagttggccgagaagctggtcaaccacttactgagccccgcctcgggactcaatatggccactcgccttggttatttcccgacgaaccgcgaagctaagctgccgcaggaagtccaggcaaagatcatgatcacgccagacaacgtcaaggatctgaaaagcgccgactggaagtacatcgtttcggtctatgatcaatggcagcagcgctgggaacgggaaattcaacgataatgacccaaagtttcgacattgaactgtcgcactgccgcaagacgtacggcgacatcaacgttctggacgacgtctcccttcaggtcaagaacggtgagttcatcaccgttctcggcccaagtggttgcggcaagacaacgacattgcgtgtgatcgggggcttcatcattcccgacagcgggcgtgtttcgatcagaggcagggaggttaccaacctgcctccctacaaacgcaacatcggcgtggtcttccaaaactacgccctgtggccccacatgactgtggcagaaatcctctcgttcggtcttcgcatacgcaagctgccccgggaagagatcgcgcgtcgtgtagaccgtgccctcagcatggtgcaattgaccggcttgaaggatcgatatcctcgtgaactcagtggcgggcagcagcaacgcgtcgccatggcacgagcgcttgcgatcgatcctgaggtgatcattcttgatgagccgctgtccaatctggatcggcgcttgcgggaagaactccgtattgaattgaagcgactgcagcggtctcttggggtgacgatgctattcgtcacgcacgatcaggaggaggcgctctccatgtccgaccaagtggtggtcatgcaatccggaaggattcagcaaatcgccgacccgaggacagtctatgagcgcccggcgaaccgttttgttgccggctttcttggtagcgcaaatttcctgcccggagaactggtgcagaattccaaggagagcagggccgaaatcaagctcagcaatggcgccgtcgtgactgcgcatgcgccgtcggccagggcggtcggagagaaggtcaccgttattgttcggcccgagtggctggtacttgaacggcagggcagcaatccgcctgcaaatcagctcgagggcacggtcggcgatgtgatctatgaaggctctgcaattcgatatgggatcaaactcactcacgaacctgaggcgcccgttttcctgcaggaacggtctaacgccgatgttttgaaacccggagacaaggtcaggatcaatgtcactaacgccgtcgttgccgcagagtgatgaacgcagaggactttgggagcgtgtggttgcgtggtctacccaagcgccgctgttcctgccgttcgccttcgtcatcttgttctttttcgttcccatgtgctggctcgttgcgacgagcatgtcctcccatgaggttggcagcgcgcctgtatttacaggcacgctagagcactacgcgaggttctggacggaccccttctatctcgaaacagcgctctggacgaccgttaagctgtcggttttgtccacggtgcttgctctgattatcgggtatgtgctggcctactacattgccgagctccctgctgaccgcagagggtttctcaccagcatggtggttgtgtccctctctgtgaacatcgttatccggatctttggattgaatgttcttctaatgagcggcggacttattgatagcgccctgaccttcatggggatgccgaaggtccgcatcatgtataccgagcttggggttttgatagggttggttcagatcgccatcccgtatgtcgttttgcctcttatcggtgtcatagccgcgatcgacccggccctcaaagaggcggcggcaagcgtgggcgccaacaagtacaagaccttttgggccgtaaccttcccgctgtcgctgcccggagtcgtggcgggcacactgattgcgttcactttgaacgccgcagcttttgcgattccgtccctcatgggcggcggtcgggtcaaaatgatgggcatgatggcctacgaacaagccaccgtgcaggggaacttccccttcgcagcggcgatcggcataagcctgacgattctgagcatcctgattactgcaatctatttgtttgccatcaatcaaacattccgcacggcgaggagagcagcatgagcgctaccacaactgtctcgacggggaagggcgtttcggccaggaaggtgtggttgccactccccacaggattaggtattgccgctttctgcgcgttcgtcaccgtcgtggcgccactgtttgtggtcgccggcgcagctttgaacgcggaagccatgttctttccgcccaagcaattgacgttgcattggatgattgcggctctcacggacagaagcttcgtgaatggcgccctcatcagctttgccgtcgcagcagtagcagccacggtctcaacgatcttcgcacttccggtcgcgctccaattgcggaaagcaccgcccacggtggcgaaggtcctgactttgtcgttcatggggccgttgctcgtaccctcggtgatctttgctctgtcgttgtattcggtgatgatctacgctttcggggtgacgaacctatttgcgctcgtcatcggccacgtgatgatcaccatgccatacccggtacgaacgatcacagccgttaccgagaacctcgaccccgcgctggaggatgctgcaagcagtgtcggcgcaaatccgtggcgtacgtttgtgtcagtaacgttgccgttgatcaaacctggtgtgatcgctggctttctctttgctttcataacctcgtggaatgacttctccatctcggtcttcctcacgccgcgcgaactgcagccactgccgatcaaaatctatgagtatctcctctaccaatacaggccattgatagccgcagttgccacctggtcggtgattggttcggccatcgtcgttctcataatcgaccgtctggtggggctgaacgtctttaccggtcgtcgcggctagtacagtagatatgatcacatctgaaatttaattttaagaaggggcgctcggcgcccctttttgcatgccagtttattccccgacgcctcgaaattacgccaacgcaaaacaggcgaccttgcaaggacaagaccgccaactcgcctccgcgtgtcgatcagcggcgaaccaacttctgcattgtggtgaggaagcgtcgattgatcttgtctcgggcgacgtggcgaccggctaccacttgtctgcggccttgaacccaaacgttgtcgatcgcaaccccatctgcaaagatccaatgatccaggatctcgtcatcttcgagatagggaacttctgtgagattgagtgaaagcatgtcggcagaattgtgtacctcaatgccactctccgcgttcagcgccatggcgccgccgcggacggcagagacgataagattgcgacccgttgagccgcccggcgctgccaggacgttacgtgcttggagtcgcagtcgttgtgaatattcaagttgccgcagctctccgttcagggaaatgagaacgttcgagtcggaaccaatgccgacacggcctccttgttcgcagaaaatttggcctggaaaaataccgtcgccaagattggcctcggtaatcgggcaaagcccagcgatagcgccagtccgcgccattcttgccgtttcgatttcggtcatatgagttgcgtgaattaggcaccagcgctggtccacaggtgcattgtccaacaaccattcaacaggacgagcagaggaccaggcaatacaatccgaaacttccttcatctgctcggcgatatggatatggattggccctccgccagacattgaggtgaccgcaagcagttcctgcggtatgacggctctcaggctgtgtggtgcgacaccaagctcggcgccgtcgattttcgcgactagagatcggcacgcaaccattagtcgttcgaagctgtcgagcgaattgataaatcgtcgttgcccctccaccggttcgagtccgccgaaatccgagtgggcgtaaaagacaggtagcagggtcaagtttattccggtggcactcgcggccgctgcgactcgttccgccatttccgcaatgttggagtaatggtttccatccgggctatgatgcaggtagtgaaactcgccgacacggctgaaacctgcttcaagcatttccatgtagagctgggacgcaacagcctcgacatcgtcggggctcatcgtcaaggcgaaccggtacattacatttcgccagctccagaagctgtcatctgacggcccgcgggtctcggccagacctgccattgcgcgctgaaaggcgtggctatggagattgcccatcgcaggcagaatgatttgatggtgttcgtcggatggtgcaggatcagcatcggtcgataccgacgcgatggttccgctctcgaccaacaccctgacattgtcgtgccagccgctcggaagaagggccttccgtgcgaaaagtgctgaactgttcaattccttcatagcttccctctgattttttgcgaaacgcaggcaactttggtgcttgcaattccgtgtattggtatatacaaaatatcagtaatgaaagacaaatatagagcaacggggatcgagatgtcagtggcaacgcccgcatccgatgaggaaatcgtcgtttggaggaacgcgcatctggcgactgtcgcgggagatcgagacggcctgggtgtcgtagagggtggcgcgatagtggtcagaggtgaccgcatcgcatacgtcggaaccgacgcaaatctcccggcgttggcgagaggcgcggttcaagtcgatttggagggccggtgggtgacgccggcattgatcgactgccatacgcacttggtattcggtggcgaccgcgcacacgaattcgaaatgcgactcgccggtgcgtcgtgtgaggagatcgcactggccggtgggggaattgcttcttctgtaaacgccacgaacaaattttacgaggatgaactcgttttgcaagatctgcctcgacttgacgccctcatggaagagagactgtcgacggtcgagataaagtctggctacggcctcaacgtcgaagctgaattgaaaatgctgcgtgtggcaaggggattggagacgctgagaccggtgcgcgtcgtgaccacttatctcgccgcccatgcgatcccgtcaagttacagaggcaggaatggcgactacatcaaggatgtcgtcatccctggactcgagcggggcaggagggaaggtctcatcgatgcggtggatggtttttgtgaaaatatcgcattttcgccagcggagatatccaaggtattcgacaaggcgactgcgataggccttccggtaaagttgcacgcggagcagctatccgatcttggaggagcaaagctagccgcgtcctatcgagcgctctcggcagatcatcttgagtgcctcgatgaagaaggtgcccaagcgctcgctatggctggtacggtggctgttcttctgccaggagcattctatacactccgagaaaagcagctgccgccagtgcaagcgcttcgcaatgccggcacgcctatcgctatcgcaacagactgcaatccgggcacttcaccacggacctcgttgctgctgactatgaatatggcagccacgttgttcggcttgacggtcgacgagtgcgtcgctggcgcgacaagagaggctgcacgtgcccttggtctcttgcatgaaactggaaccctcgaggtcggaaggtccgctgatttcgcgatctggaatatcggacggccagctgagctggtctagcggatgggcttcaatcccctgcatgcgcgaatatttaagggacgaggactgcggccgtgactttaagtcatgtccctggcgtttcgaacctggctggttctttcacctccattcgctagtcgtagaagagaagaaatcatgagtgtttttgaagttcgccacggcacctctccggttattctagcaatgccccataccggtaccgatgttccgagcgagatctgggagcggttgaacgacaatggccggcagctgatcgataccgattggtatatacataatctgtacgatggtcttttagagaaagccacagtcgttcgagcgatgtttcatcgctacgtcattgatgccaaccgggatccggaaggggcgagtttgtaccctgggcagaacaccactggccttatccccaaaacggactttgatggtgaagccatctggaaatccggtgcggaaccgacagacgacgatatcgctcaacgagtcgctactttccactcaccctaccataccgccctccaatcagagatcgagcgggtgaaggcaattcacggcttggccattgtctatgactgtcactcaatccgctcgcacattcccttcctgttcgagggaacgttgcccgacttcaatatcgggaccaatgacgggcagtcgtgtcatcccgcagtcgcggcggccgtcgttaacgtcgttcgcaatgctgatggctacacacgcacgttgaacggtcggttcaagggagggtggaccacaaggcattacggcacgctcgaaagcggcgtccacgcgatccaaatggaactggcgcaatcgactcatctttcggcagaggaaccgccattttcctatgacaccgcaaaagccgagcgcatccgcgcccgtctcagggacattctgaccaacctcgagcgcgccgcatccgaactcaagaagtgaatattgggagccactgaccatgaccaatcctcgacacaatatccgcgaagttcgcgcgccacgcggctcggagctcaacaccaagagctggatgaccgaagcgccgctgcgcatgctgatgaacaacctcgatcctgatgtggctgaaaacccccacgagctggtggtttatggcggcatcggccgggcggcacgcacctggaacgacttcgaaacgattgcggcgacgctgaagacgctcaatgcggatgagaccctgctcgttcagtcgggcaagccggtcggtgtcttccggacccacaaggatgcgccgcgcgtcctgatcgccaactcgaacctcgtgccgcactgggcaacctgggaccatttcaacgagctggataagaagggccttgccatgtacggccagatgacggccggctcgtggatctatatcggcacgcagggcatcgtgcagggcacctacgaaaccttcgtcgaggccggccgccagcattacggcggcaatctcaaaggcaaatggatcctgaccggcggtctcggcggcatgggcggcgcccagccgctcgccgccgtcatggcaggtgcctgctgcctggccgtcgaaagcgatgagacccgcatcgatttccgtcttcgcacccgctatgtcgacgagaaggcaaggacgctcgacgaggccctcgagatgatccagcgctggaccaaagccggcgaggcaaaatccgtcggcctgctgggcaatgccgcggaaattttccccgagctcgtgcggcgtatggaggccggtggtccacgccccgacatcgtcaccgatcagacctcggcccatgatccgctcaacggttatctgccaatcggctggaccgttgcccagcacaaggccaagcgcgaaagcgacccgaagaccgtcgaggctgccgcccgcgcctcgatgaaagtccatgtcgaagccatggttgccttctgggatgccggggtgccgacgctcgactacggcaacaacatccgccaggtcgcaaaggaggaaggtcttgagaacgccttcgccttcccgggtttcgttccggcctatatccgcccgctcttctgccgcggcatcggtccgttccgctgggccgccctttccggcgatccggaggacatctacaagaccgacgccaaggtcaaggacctgctgcccgacaacaggcacctgcacaactggcttgacatggcccgcgaacgcatcgccttccagggcctgccggctcgcatctgctgggtcggcctcgccgaccgtcatcgcctggcgctggccttcaatgagatggtcaagaacggcgagctttcggcacccgtggtcatcggtcgcgaccatctcgactccggatcggtcgcctcgcccaaccgcgagaccgaagcgatgaaggacggctctgacgccgtctccgactggccgctgctcaacgcactgctcaacaccgcatcgggggctacctgggtgtcgctacaccatggcggcggcgttggcatgggctttagccagcattcgggcgttgtcatctgcgccgacggctccgacgatgccgccaagcggctggagcgcgttctctggaacgacccggcgaccggagtcatgcgccacgccgatgcgggctacgagatcgccatcgactgcgccaaggacaaaggcctgcgtctgccgggcattctcgggaactgaagcaaatgcgcgttctgcgttccgcgcagtacaagcgcacgatgtggaagaacggcaagggagagacggtggagatcgccgtctcccctccggatgcgtcggtcgacgatttcgactggcgcatcagcaccgcgacggtcgctctcgatgggcctttctcgacattcgatgaagtcgatcggacgttgagcgtgctgacgggggaggggatagaactcgcgattgccggggagcccgccaccgtctgctctcagaatagtccgccttttacctttcgagcggacgtcccgaccaccgctcgactggtggatggccctatcagcgacctcaatgtcatgagccggaggggacgcttcggtcatcgcgttgcgaggtgcaggcttgatggcgaattggaggtcggatcggatgtcgcggtggtgttcgtcatcgtgatgtccggctgcgcgctaaagaattccggggagcgactggaaagcctcgatgcccttcacctggatcgcgccgaaaaagtcgttcttcgggcaaacggcccgacgacggcgttcgtcgtcgagttgctgccactttgaacgggaaaatgaacaccctgaggataccaagttgaacaggcaaaatatcgagaacaggcaagccgaggcggtcaacctggttgagaactacgggccgattggcattcgttctgtcgctgccgcatgtgcagcgaggcctcctcaaaaagaactggatgagtcgtcgtcaatcgagtttccagcggtgcgcgcccgctggctcggtgacggggatgattgagtttgaaggtcggcgatgtggtcatggagtttgtgttgcccggtccattagaactagcatgccttcggtggctgtctcgcggcaaaacgctcgccgaaatcgctctgcttcaaggcaaaaccgtctctgaaattgcgcatcatgtcgaacgcgcgcttgccgcgcttaacgcaaaatcggcacaggaagcactcgcaaaagctcacctttcgaacggcaactgatctgaaacagaggctcgttcggttggcctgcatcaggagtgttttcccctcgtagggcgaaactacatgtcgacggatttcaatgctgagctccatgcccggccgtctatctacttcaccggtccggccttcgttgagcatgttgcggtcatgcgctccggtccgattacgcaggatggtgcgcgcggcatatccaccgacccgtgtcacagtgagaatttgcgcacgcaggtggaacatcatacggaattcgtcaccgtacgcgcgtgtcgaaaatcagcgaggaggcggcgtcctggcccacttccagtctcagcctttccgaaatcgcggctttagtggacataagctcgccgcagcttatctgtcggatcggcatcctgatactgggtactgccccaaaggaactcgggcctgtgctgtcgagtctcgggtttcgcgataccgcagcgtcgtcgatcggcggcggtgcggcgcaggtgtgttcggatttccgcgttcagccggaccaaacgagccgcgtccttctcttcaacaaggacctgaacgcctacagaaaggtgcggtggaaaatgccaacaagcgcattcgccgcttcatgccaggtgataccgatcttgcagccgtctctcagcgcgacctgacccaccttgcccgccatctcaaggatcaaccgcgaaaatgcctcggataaaaaaccccagcagaagtgttcatggcacatttgcaggaagaggggtgatcccctaccctagacgccggcatgatgcacttgggttagcttttccaaaacaatccgtgattttgcatctggttaaactggtccaggatgtttagtgacacctggcccggccgtatacgagccttcatccgtgagacatatcaaccacgacgtccaaagctggaaatattaaaggtcaccggtgctgaaccgcggtatcggaaaacgcttgggcgatgaggaaaagcgagcgaactccgattgttttatccagtgaccaaatcggcgcgctggtacgaggaaagcatcgtttgaacgatacgcatgccatcggacttcaggtcaaacctcgaatcatcctccagccaggtctgaaacgttcctcgcattgcaaaccaaaaggtatatgccgcagtgtcggaggtccaaggagctagtaattcctttctcgtctctgcggatccgaaaacgctccctaacgtagcccgcacttcctgctgaaacttgcggtcttcattatggaaggccactgtatcggagactttcttatcatagatctggaaaatccgcctgcagttttcattgtcagcaaagtggttaatggctgatgtggcaaactcggcgactgcctttaatggctcctcaaccatccctgcgtcgtgaaggctgccgagctttcttgcctgccagcataactcatcgcgcaaggccagtagaatgtgcatttttttgtccgaaatgccactggatggcgccggttgttacggccgcttcggcggcaatttcctgcaaggaggcttcatcgtatcctttttcgataaacacagcctcggcagagcgtaaaatccgcctccgggtagctgcagcctcatccgacgtccttctcatgcatcgcccccctgtggcctatcgcatcagtcctcttgatgaacgtttttcagcccgacattccgcgagaaacaagaaatatgaaatcggctacggtttgccacagcaatttcgttacaaaataaacagagccaacacaggggggaccagcgctcgtagtgccatctcgctttttggacaacacgtttcaggtaacctgcaaagcgcgcagttagcgtcggagtagcctaaaatcgctctcttctgaacgtaactttcaagtggcactatcttttgccatggcagaaatgagcacctcggcgtcctcttcgacgaggaggatgttgcgatgacttgctgtcaagaatgcttcgccaacaatatgatcaagaaaggaatctagccttttgtaaaagcccgctacgtccagcagtgcacagggcttattgtggtaacccaactgagcccatgtccatacttcgaacagctcttcgagggttcccaatcctcctggtaaagcgataaaaccatccggcagcgtcgtcatcagcgctttgcgctcgtgcatggtctcgacaacgcgtagatcagcaagatcggtgtgtgcgatctccttctcggccagcgcgcggggaatgacgccgataacctctccgccatcgcttcgggccgcgtccgcaatagcacccattaaaccaatcgaagcgccgccgtacaccaatccgatgcccgatctcgccagagctttgccaagttggtttgctgcgctcacataggccggattttggccgttgcttgaacccgcaaagacgcaatatctcaaacgctcctccaattgagaaaacgaacttcttgaaggccagctatttcccgaattgagaaactccctacgagctccacgcccgggagcggcttagctaagaaaccttaagttgaacgtcaatcttcgttctggcagcttttggtagccgccgctcctccgctacgggccattgcgatgggttcgcaccaagtggtgcgagcaggtcgacttgtgcacgacaccatggtgacaccaacaagcgctcagcctgtacgctttcgaaaaaccattgccaatgcacccattcccacgctgacacctcattcaaatcggggttgacgccggaggttttgcaatgtgcagcgaatacggggcacaactcgttttcggtgatcccattcgtcattgaagcgcgataggaaaattccggcagcacaagacgaatgtcgtctgcacgtatccgcaattcctcgtgaccccggcgctcgatagcctcggtcaacggttcgccaggttgcgggtgtccacagcaactgttggaaagaacaccgggccaggtgatcttatcagatgcccggcgcgtcactagcagcttgttgtcaccgttgaaaatgtagaccgaaaaggccaaatgcagtggggtatcggaatgatgaatctcggattttggagcagtgccggtggcctccccgagttcgttgcacaatatgaccattcaggcgattgattggccggtagggtcatcacaaatctcttcgtttcgcgacgttaacttccgacactcagttagcgtttgatgccacccgaggagtgaggcgaacgtttccgccctcctgccaatcagggaagtcgcgctcctgccactgcgcatgatcaaaatattcgtcggcgatggccgagatcagcgcctgctgtcgcgtcaaatcgagacgcaacaaatcgcgaatcccgatatcatgttccttggcgaaccggattgcgcagcgatacccgtcgatgtcctccagtatcggccggagcgcctcctgcttccagagatccgtcagttcctgcagcagagatcggcgctcgtccttgacagcaaacatttccgtcacccggcgtcttgctcgcggcaggaaaacatctggagccgcaagacgaagtcgccttacatgccatctaaaatcggcttcccaataagtgtccgtggccatacagttcagaagggaaatcgaaccgccttcgaggatgagaccaggagaggtccggcgattctctacttctgagatgagctgacgatgagccgcctctgcatcgatcacaccctcagcgagtgggcgcgaatccaggtagattcgctcggtggattgcagttccgattccaaaggacgtccactgccggtagcgatttgggggcagcattgtacccgatcgagcgctattaccggccaacccgtttctcgggccacttgtactgccaagtcggtttttccgctacaggtgggtccatagataagatagataagcatgtgcatctcgcttctttcaaaaccagcgggggtgacgcgacacggtctcatgatcaagacgcttcattcggcattggctgcgccgcgcgcattgcaaaaagaacaaacgtcgaagtaaaagtgctaacgctttcgacgtatgatagtattggttcgtagaataactttatcaaaccgcattcagaatttgcaatatgagggaaaacattaaatttgtgctttaataatttatgagtactgatatttatgtcgaaattcaaattcccgcctttgacagtttggtttcatttgacatcaattcgcgtgctacggctcctggcggcagagccgcgcttgatgaataggtacacgtgtgctttttccggaatgacggcagcgcggttgtgattggccaggagctggcgaatgagcatggaaccagcaccggcctgagttcagtttagcgtcaagttcaggattgacggggagagctaaaagcacattggcgggcgatagtccgctttgaggcggcgccaggcaaacagatgcaaatcggccgtctgcgcgacgaacggcctactgctttcgatgttgacgggatcgttatagcactttcttttagaactcctgctttgccgccttcggcataagggagttcggatattgacgagtgcttcggcgacgacagcagcatccctgcctggtcgctttccgtttcgtgtcgccgagcgtgcggatcgcgcgatgacatcgccagtgacggcatgacctcaaagaacaggctgccaaagcctagtttagccgggcaactcagcaaaataccgccatggtcgaggaaaacaatgccccgaacccgacgcttgccggggaagtagctcggcctcgcaagctgatcagccgtttccacttcggcaggccatacgtcggccggtctctgatggaattggtcaccgaaccggcacatcgcatcgccgtccgccggatcccagcaatcctcgccaatgctttctccggcaacggaacctcaagcagatctggaaagagttccgaaaaggtgatcgacgttctcgcgacagagaacggatacagggacagcgagtggaagagggtgcgcgttacgcaccctcttttacttagagtccacgtccatccccgcggacgcggatgcgctcgtcaaaatcccgtgtcagccgatccacgtcatttgccgccttcggcgaagtctgttttggtgctgcattactctcttggacactctgcctcagactacctgtagtttcgtgcccttctttcgagactacatcaagttcttggggcttctcgcgattggtttttatccgatcgggcaaccgaatgatcgaggtctcgccaacgatagtagcttgaacctggggtatttcgggcgcttcggtgcgctcaatcggcttgacctcgccacgtgccgcgacaacttcctggcgttttgcaatccgatcgatggcggctgtgtagtccggcaaggctgggaatttgtcctggtagagctcgctgcccggctttcccagttgcctggccaagatgtccctgtcggcggtgtccttgagcgaagtgaaaagctgcgtccgctcgtcggccctgctcagcaaagcgctattggcgttgatgccatgggcagcgtcgttcaagagatagatttggtcaacacgtttgccgtcatcatgtcgcgtaagttcataggcggagccgatgaccgtcatcgggccttcgattttgtagcccttgacgcccctgtcacccggctcgccggtgctggcctcgaaggtcttgctctgactgctgccatcgggtttgaaggtaacggatttgccttcgatcttttcgatccggccggcttcaccggcaatgagattcctgtagctgctggtgacgctgagcctgtcgccgaccctgaaacggatatccttgttgttgaacgccttgaagctgacagggtcgccactcaggcgaccggatgcaaggccctgtttttcgatctccttggccagcgcatctacatcaacgcgccgattggcatagagcatgcggaccttttcgggatctgccttgatatccctttcgtaagcatccgccattgctttcagcgccgacccggcgtccgctttctcgacaagggagccggttgcggcgagcgtttccacgagcttcttgtgatcgccagcctgcagggcttccaccacagatttttgactgtcaggcgtccaatgtcccgcctcgtagggcgtttggttcaccggctccatttgaacagtaggactttcctcgccacgtccggccctaagttcctcgcgtttcgcgatccggtcgatcgcggctgcgtagtccggcgagactgggaatttgtcctgatagagctcgctgccaggcttgctgagttggctggccaagatgtgtctgtcagccgtgtcgctttgcacggtgaaaacctgggttcgttcgtcggccttgctcaacagggcgctcgcggcatttgagccgaaaatggcactgtgcaagacataaacctgatcgacgcgcctgccatcgtcgtgatttctgatttcgtaggcggagccgatgattgtcgtgggcccctcaatcttatagcccttgacacccctgtcacccggctcgccggtgctggcctcgaaggtcttgctctgactgctgccatcgggtttgaaggtaacggatttgccttcgatcttttcgatccggccggcttcaccggcaatgagattcctatagctgctagtgacgctgagcctgtcaccgaccctgaaacggatatccttgttgttaaacgccttgaagctgacagggtcgccactcaggcgaccggatgcaaggccctgcttttcgatctcttcggcaagcaaatctacatgatcacgtttgttggcgtagagagcgcggactttctcggggtccgcactaatgtctctttcataagtctgcgctatcgctttcaacgttgatacgagatttgtgttctcaacaagggagccggttgcggctagcgtttccacaagcttcttgtggtcgcctgcctgcaaggcctcgacgattcttttctggttattgactgccgcatcggcagcgtcgggcggcgtttggggcgccaggtctatcggggcggaagttttctcctcgccacgtgccgcgacaacttcctggcgttttgcaatccgatcgatggcggctgtgtagtccggcaaggctgggaatttgtcctggtagagctcgctgcccggctttcccagttgcctggccaagatgtccctgtcggcggtgtccttgagcgaagtgaaaagctgcgtccgctcgtcggccttgctcagcaaagcgctattggcgttgatgccatgggcagcgtcgttcaagagatagatttggtcaacacgtttgccgtcatcatgtcgcgtaagttcataggcggagccgatgaccgtcatcgggccttcgattttgtagcccttgacgcccctgtcacccggctcgccggtgctggcctcgaaggtcttgctctgactgctgccatcgggtttgaaggtaacggatttgccttcgatcttttcgatccggccggcttcaccggcaatgagattcctgtagctgctggtgacgctgagcctgtcgccgaccctgaaacggatatccttgttgttgaacgccttgaagctgacagggtcgccactcaggcgaccggatgcaaggccctgtttttcgatctccttggccagcgcatctacatcaacgcgccgattggcatagagcatgcggaccttttcgggatctgccttgatatccctttcgtaagcatccgccattgctttcagcgccgacccggcgtccgccttctcgacaagggagccggttgcggcgagcgtttccacgagcttcttgtgatcgccagcctgcagggcttccacaatggaagtctgcgaaaaatgacgctcgctgcctgcagagtcagcgccttgcattttctggtcattcgaagccatatttttttctcctgagtctttggtcgatcgtttctctgagacgtttgagggggcgttcgttgacgacaattcccaatttgatcccggatcatcttcccggtgcggtattggacccactcggccatcagtaccgatgatatgatcgacgtccgcatacgtcggttgaactgtgttggtgaccgaggttgccagtttcaatcgttcgaacagggaagtgatatcttcaacttcctcggcagaactaactgagtgacgggccatttttttgcgagaatcgatttcttcctttgccgccgctcgtttccgtttctcgatcgctatccccaggtttgttaccgttgcgatcgtgacttggtggctttcgtgggctgaggtgttagccgtcgattccgacccgcagaattccggttgcatttgctcttcagtcgtgatgacagaagactggaaaacttcgaagtcaatggcgctcgggtaaaggtccgcgctttccggcatttccacatccgatgtggatggttcgtgcagctggttctccccgaaggagctttcttgtctgccttggaaggaaagcggcgtcgttggagagatttccatctggtcgagcggccttagcaagtgcgcgttcgaaaccgacgagcgctcttggaaggcagcaggttcgagcgctgggaattgaatggaattatttggcgcgctttgctgagtgagctttgcactgagagcctcaacattgtttgccacgaggggagaagcaatgacgtcgagacgactgcgatgcctcgtcaggccgacataggtcagcttatctgaaagagcaccatcacagaggagaatggcgtgatcaactgtggccccctgactcttataaattgtagcagcatagccgtaggtaaaacccttaaactcgctatcggtccaagtgacggttcgtccagatccgtctaaccttgcagtaatgcgaaccccagcagatgtgccattctcagctcgggaagcttctgtgctattaagtccgactacagttgcaaaagtaccattgcggatgtccgcttgcagacggttttcgctgaatataatcctgtctcccaagacgagattaatcctttgctgaacgcgtctcgacgaaccctcatctattccagattccgaacttccactatctattacgcttgaccacacactcatttgctggtcttgcaatccggatttgtcaacaaacctctgatgaagagcgatattggcgcgattaacgctcctgttggagtgtgccatcacaagacgatcatacaccggatatcggtcgcaaactctattcatctcctccagcatgcggtcagtgatctggtctgacgccctgacgtttgagccgctaggaggagcatatacgaaatggacgaggcccatttgttcgagcgctgtgagatagtgcccgacggcgctcttggcatcgcgtcgtatgtcacgtccgagcttttctgtttctattcgcgaccgcgcgtcgagctgtcgaagcggctggacgagttcatagcagccggcttgctccataataatcggaagcagatcaccaggtccaacagggggcagttgccgatcgtctcccacacatatcagtttcggcctttcggttgggtgataggaagtggcatttgcaactgtctcgattagttgcgcgatctcctgcgtcttggccatcgacatttcgtcgatcacgacgatggtattttttccgatggtgcggtctttcgccttgaaagtcgtcgcgacgtcgcgaagacctttctcacgaagctcctgggccgcccggttggtgggtacgaaggcaatcaactttattttctcggtcgggagcgcttcctcgttgaacctgtccaccgcttcgttcagggctccaagtacacttgtttttgcggaacccgctacgcccaccatagtggaagctcgatttcgcctagacagataatgtaatgctcctctgagctccggtgtgaaaatgcctctatcggcgaccatatcaacaatggttcccggaacgccgaagctttcttctgcggaaagattggtgacatgacgtacagtattctgttccgcagctctcagctctgtagaggtgtagagaggttggccatctggagaatcaagccgggtcagtttgtcgcttgcgacgacctgttggaatagcaggtcgatttcttgtaccggccgtttgtagtgcgtgagtgcccgagccgccgaaatcttaagttggtcttgtccgaagcacgcattgcgatttgcggcgtggtttacgacccattccacaatattgctctcgtccagcaggttactgaactggcgaagatctgtctggaagcgcgtagggacagacgtgtcaacagcagccattccgggatcggacattacaatgtcgtcggttggcatgcttgccactcctattcccctcgctttccaatcgtgtgtgatcagccagccaggatggaaagttcggtaacggtgctgatttcaaaactcaatgagcatccggtgcggtctcaaagccattgaggggacatggtgttcatcaaaacctagaagtcagttagatggcccgcgtggctccaagtatatctgaggaagaattgaattccttaagctcagatgagcaatctttctatggtggatcgattgcgaggactataacttgatatcaggaacgcttctacacatgaaaaattcaaaatcgctacaaatgaaactttggaaatgtttacctttaagggttacggtttgcagtttgtaatcattaacgttgggtcgctggttcgatcgagcctgttcgttgaaacgcgactttcatgcctttaggcgaagcgcgacaacagtccgccgacgtctgcgtgctgaaccgtatgcttcgagatcttctcaccgccacctaccgacaatgatgtgaccaaccatgtcgctcggcttaactcaaggaacacgaatattgcacctctgtgcggatttcggtcttattgtcgtaatgactctgggaagcttcatgatcgtctcctggagcttgattgcaccccgtgcgaccacactctcgcagagcgctgggcgcagttcacgcctgcggaagtccagagtggcgtcaagctggcgagcgaaaccggtcaggtgctgaagaccatcgaaggctatatcgtcacggtaaatcatgacgcggactcgagcgcgacgtcggcacgcgaacagtcggtccgccttgccgaggtcaatacggcagtcaacctgatagaccaaatcatcagcagaatgcagcgatggcaaagcgagcaacgcggcgagcgcctcgcgcgcggggtgaggccgcacggctttgcgatctcgtcggccggtcggacctctcgcccggtttgcctccccagcaccgcggatggcgtcgggtgtgaccaaggccattgccgacaaagctgccgtcaagcaggtggctaggcaagagttccgagttgccctccccgatccgaacggtgaacctttcgcactcggggtgattccaagaggctcgcccaccgaacgagaggggagcgtcaggacagccctcggtgatcgcgcctcaggcttcattcttgcccagggttcgaagagatttttgccgaactctcggcaccctccttaagcgccacaccgctcaactgcaagcgcagcgcctcccggacgatccaggcgatcttatccgcggcaatctcgtagccgagcccgtcggcgtgaatattcgaaatgcagttacgctcgctgtcgcgccgtcctgcctgggggcggaaggtgatgtaggcacccagactgtcaggcacgcttaaccccggtctctcgccgatcaggacgattgcaacctccgcaccgaacgccgccgccgcctcgtcgccgaatgctacccgcgcctgttcgcccaaaatcaccggggcgacactgaagccgccaagacgcttcatgcatgccttgaaaagcggaacggcatgacgctcgaccgccgaggcggaaagcccgtccgcgatgacgaacgcgatgtcatggctatcccctggcattggaagatcggctgcaagcggctggcgacccagatccgggcgcgacaagtagatggtacgatccgtggcgcaggacctgatccggatcgttgataccggtgcaagctgcttggcgagggcgacaaaatccacttgaccgtgcacggcgtccctggccttcgcatgggccagctggaaatccagaattgccgaggtcggcaacgcgtcgcccgctctaccgagtccaatccgggcgcgtgtcgaatggcggaagcgctcaaacgggtctcgaccccaactcatgcggacaccccgtagctcaagagattgcgagagaattggcccgaggcgctggcgggcgccagccggcccgagtgatcaagcatgcccatgcgattgagccaagcctcaaattcgggcgccggcggacgattgaactgatgcctgaggccgacaatatcgtgataagacaggctctggtagttaagcatgacgtcatcagcgccgggcacggcaatcatgaaactgacgcccgcgacagtcaatagcaccatcagattgtccatgtcgtcctggtctgcctcggcatggttggtatagcagacatcgacccccatcggcacaccgagcagttttccgcagaaatgatcctctagcccggcgcgaatgatctgtttggcgtcgaacagatattccggtccgatgaaaccgaccacggtgttgacgagcagcgggcggagttcacgtgcgactgcgtaagcccgcacctcgaccgtctgttcatccacgccgtgatgtgcatctgccgaaagagcgctgccctgaccggtctccagatacatcacgttgtttccgacgctgccgcgcttcatcgacagcgcggcgtcattgccttccctgagaacggcgagatcgacgccgaaaccattgttggcagcctcagtgccggcaatcgactggaacacaagatcgagcggcgccccggcctcgatcgccttgatggaagtggtgacatgagtcagcacgcaggattgggtgggaatctcgaaccgctcgcgcagccggtcgaaaaggaccatcaacctggtgcaggcatcgaggttgtcggtggcgggatttatgccgatcaccgcatcgccgattccgtagagaaggccgtcgagtgtcgaaccggcgacgccttctggatcgtcggtcgggtggttgggctggagccggctcgacagcctgcccggcaggccgatggtggagcggaaggcagtgaccacgttacatttaccggcaacggtgatcagatcgtgattgcgcatgatcttggagaccgccgcgaccatttccggcgtgaggcccgtcgcaagtgctgccagcctttcggttgtcgcgtcgtaggagagaagccaattgcgaaactcgccgaccgtcatatgtgaaactggcgcgaaggcaattgggtcgtggcgatcgatgatcaaccggctgacctcgtcgacttcgtaggggatcaacagatcctccaggaatgtcttgagcggcatgtcggcaagcaggcagcgggcagcgacccgccgctcgttgcttgacgctgcaacccccgcaagcacatcgcctgacttgagtggcgaggcacaggccatgaccgatttcaggtcggcgaagacatggcgctcgcgtccaagtatgatcgaatacattttatctccgctcgtgggtatcaggcagcccatttcttgcgcaagggcgaagctaccttcaagattgtaagtccagcccgaactgggcagtgcgggcgccatgcctcctgaaagctatgcacgatccatgccactcctggcttgggcgcgcgcggtccattcatcgaagggcttgtgctcctaaggtgcctccggacgatgcaagccgtgaccgaagcatttcggatccgccatggatcatgaggcgttcggaactcgattgcccgaggcggcttcaactgaccgtttgcccggccttcactgtcgaggctgcctttccaatgagcctggagagatagctgccaaccgcagcttggtcatccgcggccaccaggaggtcatttctcacctctatcatgacatttggaataccgttcgcgatgccgtgctcgacgagcgtgtgcgtgaccccatcggctggaccgtatggctggttgcgcatgacgacatacttgcgatcggccccttcgaattccgcgagaattgcatctgcgagcgtcgtgtcgctgtcgtgcaatatcccgatctcgacctcgcgcttcttgccgaaatagacgggggtgaaactatggactgtgacgagcatcgtcccgcgcccctgggccttgcgagaggcgagaatttcggacagtccatcacgaaagggtagataaatctcgttgatccgcgtcaggcgatctgcttccggcatgctctgatttcccggaacgtcatagatctcgcttttgccaacaattgcagacactgcctccggcgggcgattgcagtcgtaaacgagccgcgaaaagcgctggtaatagaggaccgcatcgagagatgacgaaagatatcgtgcgagttccagggcgcccggatcccaggcgatatgacttgaacgcgcagacgcatcaaggccgaggtcgccgagtgaaggcgggatcaggtgtgaagcatgctcgcatacgattacaaacttgccgagcgcggccttgttttcgatcgcgattgcagactcgccaggggcgagcaacgacaatttacccataacagtctccgttgatatccacacaataacaacgaaaacaataaaagcaacatgatatcaacattgcataaagtagccctctgtcgcggtggaggtttcgccacgtcacggcccctcgttcgctacgccgatttctaactgttgccgaaaacatgggcaaaatgcctgcaaaatatgcctttttgtaaggcagatcctcagagcattttatccaattcccatcctgtgccgacgcttgtgctgtcagccgcgatcactctcatggcgattttcttagctacggaaattgaaaaaccctcatcgggtgtgttgacaaacgcaaaatatccacataaatccacattccaaggagatcgcaatcgtggatttttcagttctttcgctcagctcagcaattgtttccggcaagctcacatccgaagcgctcgttcaggaatgcctggcgcgcattgcgcggctgaaccccatcgtcaatgccttcagccaggtgtttgaagaacaggccctcaaagaagcgagggcctgcgatcgcgaggcagccgaaggtcggttccgtggtcctcttcatggtatcccgatgggcgtgaaggacctcttcttcgtggaagggcagctatgccagcgcggatctcgtgcctataaggatttcgctcccaagatgacggcgccgatcgtccagaggatgattgacgccggatctatcatcatcggcaagacgacaactaccgaaatggggtggtccggttccggcttttccgaattctatggcccgacgcgcaatccatgggaccccaagctcacaagtggtggttcgagctcgggttcgggtgctgcgctcgcggcccgaatggttcccttcacattggggtccgatggtggcggttccgtgcgcatcccggcagctttctgcggtgtgtttgccatgaagggctcgctggggcgcgttccggcttggccctggagcgcgacggagatgctgtcccacgccggtccgatgagcgtcacggcaaaggatagcgctttcttgttcaatattgccaaggggcccgatccgcgagaccatcaggcgctgccggacgacggagcagattacactgaaacgcgatcgacaaagtccctccggattggttttgcaccaagcctcttcgggttcaaagtcgcgccggaaatcgaccgggtcgtgcgcgaagcggtcgatgcgctcaccaaggcgctcactatcgatgttcgttcggtttccccggactgggaagatccgatccgtatcttcgagacactctgggttgccggccggggcgtcgcctatgggtcccagtcggatctttccgattttggcagcggtttccgtgcgctcgtcgaagcgtcggcacgctacgatcttaaggattatctctcggctgcgaaagcgcgcgcggaatttgctggtcgcgtgcacgcactctttgaggacgtcgacctgctcctcttgccaaccatcccggtcgagccgtttgcggcggatcgggaggcgcccgaagggttccaatcgccctcggaagtcctcgcgtggacgggctggacgccctttacatatcccttcaatctttccggcaacccggcagcctcgttgccttgcggcctgaccgtcaacgggttgcccgttggcctgcaggtcgtcggccgtcgccacgccgatgcgcttgtcatggcattctgccagcaggccgaggaccatcttttcaaaaacaacaatcctccacttgtcgttgctggcgacaagatggggtggggaacgcccagcaaatcaactgtggagatgtcgtcatggagttcaatagaagatcgctcttaaagagttcggcgcttgcgggcatcgcacttggcatgcctatcctcaatactaagttcctggtcaacccggccaatgccgcggaaaacaaggtccttaaatttctctcggccgaaactctgaccggcaactgggatccgtcttctcacacgacgctggcgcagatcaaccttgagagctttgtgttcggttatctaacccgcgcaccgatgacgccggaaaagcctgacgagctcgtcatggaactggcgaccgagatgaagctgatcgacgagcacacgctcgaattcaagctgcgcgaaggcgtcaccttccacgacggcaagccgttcagggccgaagacgtcaaggcgacattcgagtatgcaagtcgccccgaccgaccggccgcctggtatcccggtccctgtgaagtcgaagtcgtcagcgattacgtcgcgcgcgtcaagaccgacaaggccggctaccccgcaagccttttctggttcctgtcctccttcctgccgatcatgtcggcaaaggacgtcgccgacccgaagacgctctctgcccggccgaacggcaccggtggtttcaagttcgtcaagcaggacggcaacacgaccgttctcgaggccttcgacaatttctacctcggcaagccgacgattcccggactgcatttcagcttcgtcggcgatgcgacgacccggacactggcgcttctgaatggcgaggccgaccttatcgaacgccttgaagccgaacaggtcgaaacgatcgaaaagaccggcggcttccagcttcacaaggcgatctcggtcgagaacaagtatctttggttccgttgctcgaagccgcccttcaacgactggagactgcgtcgcgccgtgtgccacgcgatcgaccggtcggtgatcgacgatattctcggcgtttccggtcacgcgtcgaactgctacgtgtctccggtcaagttcggctatgtcgatatcccgaactatccgaagttcgatccggaccagtgccagaagcttttggcggaagccggcttcccgaagggcgaaggtctgcccgaactcgaatacatcacgtcggtcggcttctacccgaagaccaaggaatatgccgaggccatcacggcgatgcttcaggaacagggcttccccgtcaagctcaacgtcatggaagtcgcggcctggggtgacgcgctctacgatcgtcccggcggcgggcccggtcatatgatcgactgcggctggtcgacgggttcgccggaacccgatctggtgctgaggacccatttccactcgacgacgcaccgcatctgcggcatccaggatccggaaatcgatgctgccctcgacaaagagcgcaacgcctcaaagcccgaggaacgcaagaaggtcattcagaccgagctgatgccgttgctggcggagaagacgccatcattttctctcttcacgtccgttttcatccacggcatgcgtgatggcctgagtggtctctacatctacccgaatggtatgatggacgccaacaaggcgacattggcctgatccagcgctgcggccactgcctggcagtggccgccttggccccgacagactagggtaagtacatgttccttctatcattcctgatgagacggcttctgcagggggcctgatcatccttctcgtcatattcatcatcttcacgctgttgcgtgtggtgccgggtgaccccgcgcgccttatcgtcggcggcatggcccctgatgcggtcgtggcgatgaaggcaaaggaacttggtctcgatcgggccatcccgctgcaattcgtctcctatcttggccatttggcgaccggcgatcttggcacgtcgttcgtcaggccgaagagcggggcgagcctggccggctcggcctataacgacccgacacgcgaagagcgggcgaaggtcctagatctcattctcgatacactcccgatgaccctgcagctcgcagccgtcgcactggtcatcgcgttgctcgttgctgttccgctcggccttgccggcgggctctatcagggtcgctggcccgacaaactcgcgctcgcattggggtcgatcttcgtctcgaccccgaacttctggctgggcatcgtgctgacgctctttctgtcggtgaagctcaggcttctgcccgcgatcggctacaacggcttcgaatacaccattctgcccgcgatcgtgctcgcggtggagattgcgccgttcatcctgcgtacgttgaccgtttctgtcgctcaggtgttgcgcgaagacttcattcagcttgctgctgttagaggcctgagccgcgggcgcacgatcttctcgcatgtgctgggcaattccgcggtcccgttgatcaacttgctgggtgtgcaactcggcatgcttctgggcggcgtcctcgtggtcgagttcatcttcgactatccgggccttgggctcctgacgatcaatgccgttcaacagcgcgactttccgctcatccagggcgtcgcgatcttcatttccgtgatgttcgtggtgatcaacatcctggtcgatcttatcgcgatgaccatcgatccgagactggaatactgagatgaccgatatcgtagaattgagcgccaccgagcgcaccgtcgtcaagcgcggcaccacaccgaccagacgcatgttgcaaattgccgtggggcgcctcgactttcgcattggcctcatcggcttcggattgctgcttggacttgcgattctcctgccatttgtcagttcggttgatccgctcaagatggcctacagccacaagtttattccgccattcccttccgagggctggcaatggccttatgtgctcggtaccgatcaactcggccgtgacgttctgatgcgctgtctcgtcggactgtgttattcgctgttcatcggcgtgacgaccgtggttctgatgttcatcgtcggctgcagtctcggtcttcttgccggttttcgtggtggttggctcgatacggtcatcatgcggctgaccgatgctcagctgtcaattccgatgatcattcttgccatcaccattctcggcgtgtcacgcccgaccgtgcctgcgatcatcctcgtgcttggcctctccggctggccgctctatgcccgcgtcgcgagatccgtggcgctcggcgaacgcaatcgcggctatgttctcggtgagagggttctcggtgcctcggaccttcgcatcatgctgttgtttgtggcgcctgtcgttctgcctccgatcgccttcgtcgctgtgctcgatatcgcccgcatgatgatcttcgagtcgatcctcggctttctcggtctcggggttcagccgccgacaccgacattcggcaacgtgatcgcggattcacgaaagtatctgctgaacgcatggtggatcgcgacgatgcccggtctgttcctgctgatatcgctgacctgcctcaatctgatgggttcggcgttggagcgcgcgcgcaatgcggttctgagaggggatgcgtaaatgagtgatccaatcctagctgtctccaatctctcggtcgatctcctgcgggatggcggcaaacggcgcatcgtcgacaatgtggactttgcgctccagccaggcgaagttctcggcctcgtcggcgaagccggatcgggcaagtcggtgctggcgcgtgccatggtgaacgccattcaagcaccgctggaaatctcttccggtcaggtgatttttgaaggaaaggacgtcctctccctcgatgcgcggggtcttcggtcgatcagaggaaaccgcattggcttcatcggtgcaaaccccatgggttcgcttgatccgaggctgccgatcggccatcagatcgtcgagaagcttcgatctgtccggcctgatatcggtaaggcggaagcgaaggaaaaagttctcgatctccttggccgggtgcatattccctcaccgcgctctcgcttccacgaggcgcccttccaattctccggcggtatgatgcagcgcgtgatgattgtcgatgcgctcgtttccgagccatcgcttgttatcgccgacaatattacgcagccgctcgatgtaacggtcgcagcccagattatccggcttatcgacagcctcaggcaaagcctcgacacggcgttcctgtttatctcttcgtcgttaccggtggtgtcacagattgccgagcgaacgctcgtcatgcaaggcggccgcatcgtcgaacggggcaagactgccgatattgctgccaacccgcagcaagcctatacgcgcgccctcctctcgcgcattccatcgatctggaagaacgtgtcggcgccggaagcaaaagacggtgaggctgtcctgaccgtcgaaaatgcaacccgaacctatagcgtgcgccggcgcgatgcgttcaatgccttcaacgaagtcaaggcggttcgggacgtgtcctttaccgtcaaggcgggtgaaaattttggcatcgtcggggaaagcggttgcggcaaatccacgcttacgcgcctgcttgcctggctcgaacagccaaatgccggtcgcattgcgttcctcgggaagaacctctcgagtctctctgctcgttcgttgacggagatgcgcaaatcgttccagcttctgctgcaggacccctatggatcgctgccggcgggcatgtcgatcatacgcatgatcgaggagccgcttctgatccacggcgtcggccggcgtgatgccgagcagcgcgcgcaggaggccatgcgcgaagtcggccttcatgcggacctcgccgaacgattgcctgtggggcttagcgccgggcagcgccagcgcatcaacattgctcgagccctggtgctgaagccgcgcctcttgatccttgacgagaccttgtcggcgctcgaccaggtcgagcaggccgagctcctcgatctcttcaaacggctccaggcggcacacgggttttcctacattttcatatctcacgacctggcgctggtccgtcgtatctgtcaccgcgtggcggtcatgtatctagggcgcatcgtcgaactggctgacaacacgacgctttttgaacatccgcaccacccgtatacgcgggcgctgctgagcgccatgccgacgctggaggaaaaccgtttcccgggcgcgcaatatctgctcgatggcgagcccccgagccccattcatcttccggtcggctgctcgttccgttcgcgctgcccgcgcgcgcagagcgactgcgaaaagaccgatccgatgcttgtgggttctgatggcgggaattacgcagcctgcctgcatcggcatgaggacgaggcggtccatgtccagtgagatccgcaaggagatcatcctggagcgtctcggccgtgatcagcgcgtcagcgttgtcgagctttcagcagagttcggcgtttcgggcgaaaccattcgccgcgatctgaagaacctcgaagcagaaggtgctgtgcgccgcgtgcatggcggcgcaattccagccggccgcacagccgacacgccgattaccgagcgcatcaagctcaactcgactgagaaggatgcggttgccggcgtggcgcgcaacctgatcaatgacgactgtgtgatcttcctcgataccggcacgacgacgcttgcgctcgcgcgccggctgatcggcttcaagaagcttcggctctacacgaattccctgatgattgcacaagccgcctgccagcatttcggcgtcagcgtgcacgtgacgcctggaaatctgcgaccggtcgagcaggacctggtcggctatgacacgctatcctacatccagcagttccacttcgacatggtcttcatgggtgccgcggcagtcaatgtcgaatatggcttcatggactatgaagaagacgaggcgcgaatccgtcagatcctcataaagcggtcctcgcgaagcgtcatgctggccgatcattcgaagtttggaagggtcggcaatgtgatcaccgctcccttcgggcaaatcggtgcgcttgtgaccgaccggcgtccgccggaagacatcctcggcgccgttcgggcagaagaactggagatcatccatgcttgacgcggcgacgacacggcggacggatttcgatgcgatcttcgaccgaatttctgccatcggtgctcatcccggagcgggagtgacgcgcctcgcggcgagcgccgaggacggcatggcgcgaggtgtttttgccgtgtggatggaacaggcagccgtccagatcgcgaatgatgcgatcggcaatcagtttgcctgcttcgattgggccggtcaggatgcgccctggatttttgcgggctcgcatctggacacccaaccccgaggcggtcgtttcgacggcaccttgggtgtcctgactgccggacaggccgcgctcgctattcacgccgaggtgcaacgcggactgtgcaaaccgcgctacaacctcgcggtggtcaactggacgaatgaggaaggcgcccgctaccagccgagcctgaccggcagcacggtcttctccggcgcattggcgcttggcgatgcattggaactacgcgacggagacggcgtatccctcaagcgcgcgctcgaggccataggcgtcagcggcagttcgggaattgttccccctcccccgaaagcctatgtcgagctgcatgtcgagcagggacggaaacttctcgaagcgggccgaaagatcggcgtcgtcgaaggaacctgggcggcgcgcaagaagaccgtccgctggatcggccgggcagcgcatacgggtccgacgccgatggccgatcgccgagatgcgcttctcgccgcagcaagaggaattgccgccttcgaagcagtcgtcgcggccagccatcccctcctccaccgctccgctgcgcgcctcgtggtcgagcccaactcgccgaacgttgtcgtcgaccgggcgactgtgtggttcgagctcagggggcctgacgtggccgaactcgacatggcaggtgagctcgcccttgccgcgctcgaaaaggcggcagccgaaaccggcacgcagctggaaatcgtcgccgatactttgcgcgatcccgccagcatggacaggcggttaatggcactcgtcgatcgcacggcacgttcttgcggtttcgagccattgaccatgcgttcggttgcaggccacgatgctgtcgccttgcaaaacagtggtatcccgtcggcgctgatcttcattccgagcgtcgatggcatcgcccatcatcccgacgaactgaccgagccacaggacgtgcaggcggggctggcggtgctgaccgccacgcttcgcaacatcattgagggagagttccatgcaggatgatgctgcagttcaggctgcgctcgacgcggtcggcctttccggcgccaccctctcagctccgattggcggagtggtgtcgcccattcaccgcggcgtcgaaaatctctgctttttcgcaagcaaggcggatcagccgcgggttttcgtcaaacgtctccacgatgacatgtctcggtttgttgccctgaaccatgtggcggaggccagccgcaaggcaggcgaactgggcattgccccgcggctcatccatgccgctcccgagggcggcgtcctggtattcgaagcgcttggcgaggaatgggcgtgggggcatgccgatgtccttcgccgcccgcgggttctcgaaaatcttctgacggcaaaacgcagcttccatcaggctgagaggcttggcgaaacgcgcagcgttttcgagctcgttgccgcctaccggcagcttgccgaaggagcggatgtgatcttgccagcaccggtattcaccgtctctgctgccgtcgagcgcattgccggcgccatcggcgccgcaggtgtcgatacggtcccgtgccacgcggacggcatctcgtcgaacgtcatggtcggaccggacgacggagttcggctggtcgatttcgagtgggcgcgccaggcggaccccgcgtacgatatcggaaccgtgctggccgaactcctcccattcgatggcgaggcgctgctggccattgaaatcgcaaccggaaagccggatgcgagcgtgctcgcgcgggcacgcctttatggagcggccgacgatctcatgtgggcgctttggggcttcatcaatgccgcacgctcgccgcgcaagcatgtggaattcttcaaatacgccgaatggcggcttctgagagcccgcacggtcatcgaaggaccacgctttgaaacatggctgaaacaggtctgatggagagagcgatgagactgagattgggtgaaggcgcatcgcaggccgagcaggcgatcgagcaggccatcatagccgtggcggactggcgaggcctcgaggtttcctacgaaccagtacccgggggcatcagcaatcccaactggcgggtttacgtcgaaggtgcgccgcacagcttcttcgtgaagatacccggcgctgggaccgaaatgttcatcgaccggagaactgccaacgaagccggccgcagggcgcacgaggcgggcgtcggcgcccggatcatcgagttcttccccgaaacgggggtcgaggtgagtgaattcgtcgaggggctcagaacatcgacaaacgccgattttcttgatcctgtcatccgcctcaacggtcttcgtgcgctgaaggccttcaacgacaccgcaccgctttcgcagcgaaagaccaccttcgacatgatcgacgaacatttccagcaggtcctggagcttggcggcgatttcccgagcgacttcggctggatgaatgcgcgctatcgcgaggcgcgagctgcgctcgaggcatcgggtctcgatctcgcgccctgcatgaacgacacactggccggcaatttcctccttcattccgatcgccgggtcatgcttgtcgatttcgaatacgcctccaccaatgatcgggcggcggaactcgcgctttggttctgcgagatgtgcttctcgccggagaccgaaaaggaactgatcgaggaatattatggccgggcggatccgggcgttctggcgcggatcgctttgttcaaggctctcgtcgacctcaaatggtcgacctgggcgatggtgcagaacgaagtctcgcgtcttgacttcgacttcttcaaatatgggttctggaaacatatgcgcgcgcgtttcgcaatgagcaattcgctgtggccgcaatggctgaaggcggtctgacacatgcaaagcactgaagaggtgatctctcccgattttcttcgccgcctcgcggcagttgccgcccgcgagacattgccccggttccggttgccgggagccgtcgtcaacaagattgccggcgggttcgatccggtcaccgaagccgaccgcgaaacggagaaagcgcttcgagcgcttatccgttcggaatatcccgatcacggcatcctgggcgaagagttcggcaatgaaggcgcggatgcgggcctggtctgggtcatcgatccgatcgacggaaccaggtcgttcatatcaggtatcccgctctggggcacgcttgtcgggctgaccagggatggtgatgcggtggccggcatgatggcgcagccttttatcggggaattgttttatgcgacgggcaacggcgcatactacgagggccagcacggacaaacgcggctcgcaaccagcgcgacgaagaaccttgccgacgcgacgctcttcacaacgacgccggcgatcttcgaagccgaccggagagcaagctacgaccggctcgaaaaacaagtgcggctcgcgcgttacgggaccgattgctatgcctattgcatgcttgcggcagggcagatcgactgcgtcgtggaagcgggcctctatccctacgacatcgttgccctcattccgatcatcgagcaggccggcggcgtcgtgacggactgggacgggggaccggcagaaaatggcggcggtatcgtggcggcggcaaattcctccctgcatgcgcaaatcatggctttcctgcacggggattgaccacggggcttcctcagacggcggacaccggtctgacgctttcggtatggtcaaccgtggatgatttcgaggtcgccccttttggcggccgccaatatatttgccgggggacgttgatcggtgaccaatgtgttaacgctggaaaatgcggcggtaatgacattgcccgtcttgccgcacttggaatgatcggccagcatgatgcttctggccgtctgcttcagcagagcctggcgaattcgcgcttcatcctcttcatagtccatgaagccatactccgccgcgattgccgccgcacccataaagaccatgtcaaagtggaattgctggatgtaggacagcgtatcatagccgaccagatcctgctcaatcgggcggagatttcccggcgtcatttggacccggacgccgaaatgctggcaggcggcttgcgcgatcatcagggaattggtgtagagccgcagcttcttgaagccagtcaggtggcgcgcaagggacagggtggtggtgcctgtgtcgaggaaaatggcgcagtcgtcggttatgaggttgcgcgccatcagcgcgaccgcgtccttttcgagcgcattgaatctgatgcggtcggtaatcggcacatccgcggttcggccggccggtatagcgcctccgtgaacgcgccgaacggctccctcggcctccagatccttcaggtcgcgccgaatggtttcacccgaaacaccgaactctgtcgaaagctccagaacgctgacgcgttgatcacgatcgagtcgttcgagaatgacttctttgcgaacttcactcgacattgacagcttcgtcctcgggtcggtgcgggggtcgacagtaacgctgatgctgacaatcccttaaagcggcagatctatctcgcaagccttcggaaaaggttgcgagatgcttgtaaggatgacggtgaaccgggaagtcgacgacgttgtccttggatttgtgtatttatgtggtgtttgcggatctttcaaacaaattacgcgatcttccaccgcgcaatgaccatcccgcccgcgcgagaatcgctgcctatgtgatcagcaacgcgcttgccttccatacaaaatgaacccttcgatcgaaatcctggtccggagtgaatgcgattctgtccctgctccatgtgggaatgttggaatattgagggcatatcaccggagaattgagctaaaatccacaaaagcaacatctgaaaacctcaaggttcttgagggcgtgcctaagcaacatattgaaaatagaaagaaagttatgacccgtaacggatttttcagaactgtcgtcgatgatgattagcaactgtttgactcgaaatggattcaaaatgcagattttccacaatgctttgcaattgtcccaccgcatgcgatccattaaggccaagtttgccgtggtgatcatagggacagcgatcgtctcttgcgcgtctgtcggagcattgagctaccagatcggaaagaacggtttgatcgaggcgagcaagatccgccttgaagcgattgcagccaatcaatcgaaggcgctccgggcctatgatgaacgggtcgagcagacgctgaccgagatcgcgcagagccagtcgctcggagagatgacggagcaggccggaaaggccatcgcaatgtctgatgccaagataagggaggcgttccaggacatgtcgaagagccccgcacaaagagcggctttcgacggatcgaccgtcaagatgctctatgccgtcaagcatagctcggtgcatgggccactcttcagcgcctggaagaatgccgatctcagcgatatcttcgtcatcgataacaatggccaggtggtctatacggtcaccaagggacccgagttcatggcggccgtccaggattcgcagaatgccgccctgaagtccctgtttgcctcatccatcgccggaccggccgaccaagtgtatcggacggggttcgtttcgttcaaaagcgaggaaagcgatgtttcggcttttcttgccaaaccccttgccaacgttgtctggggctctgtcgtcaagcgcggcaccgtcgtgatccgtatcgcgccggcaaagcttttggcgctcatttcgcccgagggcttgggacggagcgtcgacgaggcgtttctgattgccgccgacggcaccttgagagcaggcaacgtcgcagcggaaaatggagtgccgccggagctgctcaaggccgcgaacgagcagaagaatggctccgtcttcgctgatggggcccatggttcaaatttttactcctacgtccctgtcaccctctttggtcagccgcaccttctcgtcatcggccagagcaaggctaatgtcgtctcctcggcaaacgagcttgcaaagtgggccgcgctgaccgctctcgccgtccttttcggaatgggtatcgtcgggtacatcttctcctcccgtcttacgaagccgctcgcggacatcacaggcctgatgaaccgcctgaacaatggcgatcaggcaatcgagatccggtccgtctcgcgttctgacgaaatcggcatcatggcgcgggcgctcgaatccttccgccagggggcagtcgacaaggtgcgaatggaggaggaggcgatccagcgtaaccgtcagatcgaagaggaaaggcaactccgcgagacggacagggaaaaaagcgcggccgagctggaacatgcggtctcggcactcgccgccggcctgaagaacctggccgacgggcggctcgatcatcgcattgcgactcctttcgcgccctccctcgaccaactgcggaaggacttcaacgcctcgatgatgcacctgcaggcgacgatgcgccagatccgcgacaatgtcgaaatgatccagggcaacggcaaccagatggccgaggcggccgaggatcttgccaaacggactgagcagcaggctgcttcgctcgaagaaacggcagccgccgtcgacgagatcaccgtcacggttcgctcgtcggcggaacgtgccaaggatgccgaccagatcgtccgccaggccaagcagagcgccgacgattcagccatcgtcgtcaacaatgcgatcgatgcgatgggccggatcgaagaagcctcccgccagatcgagcagatcaccggcgtcatcgacgagatcgccttccagaccaatctgctggcgttgaatgccggcgtcgaggcggcacgcgccggcgatgcgggcaaaggctttgccgtcgttgcccaggaggtgcgtgaactggcgcagcgctccgccaaggcggccaaggagatcaaggtcctcatcaacaagtcgacggccgaggtcaataccggctcgcatctggtccaggaaaccggttcggtccttgcgaagatcagctcgcagatcgtcacgatcagtcagcatgtcgagacgatcgcccgcggcagccacgatcagtcgagtgcgctgcagggggtcaactcgaccgtcaatcagatggaccagatgacacagcacaatgcggcgatggtcgaggaaacgacggccgcgagccgcgaactcgcctcccaggccgacagcctgctggccctggtccagcactttcaaatcggaggcgaagatgaagcggcgttggcccacagtcgggcggcgtgatttgccgcagttgacatcgattgacgcggcgtcccgttctttcaaggcctcttctacggccggtcccgcgcatgtcgggctgggatggtggcggtgaacccagccgccaccacggtcttcaactttccaccatgaaacgggagatgaatggcaggcttgcagcaccgacggccttcggcgtgttcaatatgccgctcggcatcacggtcacttcgggaaccagcttttgcagcgagacgcagatgttccgatagacgacattcggcacgaatgaagaaacgatcaccgcttcgagctcgacaaattgcgcgagcgacttgacgatgccctgcatcttttccgccagtttgccttcccattcgagaaccagactgttctccggccatggtgcgagcggctgccacaggtgatccgttggcgcgcccacggcggtcaatacggattccaaagatgccacgccgacatcgaaactgaccaccgaattgccgtggtggatctggtggttcaagaccaggcggctgtggaggttcgcgccgatataaaagtagagataatcggaaaacggcttggcgacaccgaacatgctttcgccgctggccgcagccgtaatgtcgttctgcacgaacaccgagtagccggtaagctcctcgacttccttctggagcgagtcgaagtaggccttttcctcacgcccctccgaagcgctcgacggaagcgcaaggccaatgccggctagacgcttttgagcattcttggggacgatgttcaccgcctgacgaatggtctcgatgaacattgtctggttgctgtcgcgttcgggctgcggattaggcaattgcatatgatagcgaacggcgccggcaaaatcgatcagaacgacgtcggtacgcttcaggccgacactgatgccgatcgaaaaggccccttccggattgagggcaaccggaacggtcggaggcccgacccgtcccttctgggcttcccccttcgcaaccagtccttcctgctccagcgacctgaccagcaccgaaatagtctgggctgaaaggcccgtccgttcgccgatctccaatcgggtgatctcgctgttctgaagcaacagcgacagcagcaggcgctcattgtaactgcgcacgctgaccgcattcaggccggttgcccgatcggcaatacgcaagggattgggtggtgcaaaacgcatatcaggcatcaatgcaatcctcttggagtaaggcataaagatgtactggcatccattcgtaacgtcgctgcggcaatatcatcatctccaaccgatcgcctcgacttccctggcgagcgccgttcccaaggcttcatgcgcttcccgattgatgtgaaagccatcgcgcggatcgcaagccgcgacggtggcggcgtcaaaaaaatgtacttcgagcgaatcggcaatgatttcgaattcgagggcgagacgccgggatttctcctgggcgccgaaaaatatgggttcccattccttgatatcgtccagcatcggcggtggagcaaccaccatgatttcggggggcttgccggccggaccgggcgccagctcccggatatcgtagaccaggcagccaatccccatcgccacttcggagggaggctggtggaaacgggctttcaggtcgttcgtcccgagcatgatgatgacgagatcgaggattgcgtggctcatgaggcatggccggaggtaggttcggccattcttcatcgggccttcgatcggatcgtctcgaaccgtcgtacggccgctcaagccctcctcgaccacataccacttgcttccaagctcccgtctcaaaacgcctggccagcgctcgtccggcccatatcgatcgagcggcgagccgcccggaatctggccatgcgtattcgagtcgccgtaacataagactgaccgcatttcctccccacctttatggcaaatcataaagacgcatgaacattcaacggcgattatggcctttgtcgatccatggtgcaagtttattgatattcattcagtctgaataattattgacagccgtttatccgtgtggcatttctatgaatgggagagcaagattttccaggaactgaacatagccagcccagtcatccaatggctttggcccgcgattaaagccgcttcagcggcctggataaatgtgtctccgtggcaatggagatccgacgtcgagaggacgacggtgtttgagcaagggaggaaatctcgtgaacggctatgtgaaatctatcctcggggctacgcttttgatggcgtcgaccgcgggcccgctatgggcggatgaagtcaagtttatggacggcatcacgccgaaggctggcgacaatccgcagacggaagccgggaagtacaagaaggactgcggctgggttatcggcatgagcgattttggcgtcaacgccaacacttggaccgttcaggttgctcacgaatcggaagcggcggccgcagccaacaagtgcatcaagaagttcatcctgctcgacgccggctttgaccagaagaagcaggttgccgacatcgaagacctgatcgcccagaaggtcgacgcgatcatcgtgcagccggtcacctccacctccgcaaacgcctccatgaagaaggcgattgccgccggcatcccggtcatcgttcataccggtcgcgtcgaaacagaagactacacgaccgagatccagggcggcgccgagcacttcggcaaggtcatgggcgactggctcgtcaagaccgtcggcgataacggcaagatctgggttctgcgcggtctcgccggtcatccggaagacaccaaccgctataatggccttctggaatccctcaagggcacgaacgtgaagatcgtcgccgaagagcacggtgactggcagtacgacaagggcaagagcgtttgcgaaacgctttacctgaacagccccgatgtcgatggcatctggtcgtcgggtgccgacatgacgcgcgcctgcgtcgacgtcttcaagcagttcggcgccaagatcccgccgatctccggagaaggcaacaacggcttcttcggccagtggatccatgacggcttccagtcgatctcggctgaatattcgccggcccagggcgccgaaggcgtgcatgccgctgtcgcactgctggagggcaagcagctctacaagcactacgactacaatcctccgggctgggacctggagaaggtcaagaagtattaccgcgacgatctctcggcgaacgtctggtggccttcccagctctccgaggacgacctgaagaagtattataccaagaactaaaatagcctcccaaggcgcatccgccggtttcattccggaaccggcggatggtgaccgagcggagctgcatggattgggaggaacgaatggccaaccttatagaaatgtcgaacatttcaaagtcgtttggcggaagtctggcactggatagagtgtcgctggagctcttgccgggttccgtccatgccctgatgggcgagaatggcgctggcaaatcgacgctcatgaagatcctcgcgggcgttcaccagcctgatagcggcgagatcttcaagaacggacacaagatcgccttcctcaatccgaaagaggcgctcgacttcggcatatcgacggtcttccaggagatgacgcttctggcgaacctgacgatcgccgaaaacatgtttctcgggcgcgagcccgtaacgcgcttcggcaccgtcgactacaaacggatgaatgccgaaaccggaaaggcgctgaaagagctgtcgctcgatcttgatccgcggacgctggtttcgaacctcacgattgccgaacggcaattcgtcgaaatcgcccatggcatcaaagccgatgcctcgatcttcattctcgacgagccgaccgccgcactcaacgccgctgacgtcgagatcctcaacaagcatatccgccgactgcgcgatgcgggcaaggccctcgtctacatctcgcaccgcatggatgaaattttccagatatgcgacacggtcacggttctgaaagacggcaagctgatcggcacgcgcccgctttcggaaatgacgccgacatcgctgatcgcaatgatggtcggccgggaattgaaggaccttttcccggcaaggaacgcctcggcagcctgcgaaccgatgctcgacatcaagcacttcaagatcggcgcttcgtcaaagccgttctcactgcatgtttgcaagggtgagatcgtcgcacttgccgggctcgaaggacagggtcagcaaaaactcctccgctcgctggtcggcaaattccagccgttttccggcacgatcacactgaacggaaaatcgctggccttgcccgtgccgaacgagaacggtgtgcgcaagctgcagcagatgggcgtgggcttcattcctgaggaccgcaaggaggaaggcttgttcctcaacctcccgatcgcgcacaatatcgagatcgcgctccattcggcacgagcaggattttcccccgcgaagaactatcgcaagctcgttgccgacacgatcaagcggctcaacgttcgcacgatcaatgcgtccgcgcccgtcggcgcgctctccggcggcaatcagcagaaggtcctgcttggccgctatatcgccgccaatctcgacatcctcctgatcgaggagccgacgcgcggtgtcgatatcggcgccaagtctgaaatctacaagctgcttcgcgacttcacgcagaacggtggggccgtgctggtcctgtcgagagaaactgtcgagctcatcggcctttgcgatcgcatctatgtcgtccatggcgacacggtcgttgccgacatgcccgccgccaaggcgaccgagcacgacatcctcgacgccgccttgagcgcgtgaacgccaacagagaaccaatccgatgaccaagaccctcacaagactattcaagggaaatcagagccgccaaggtctctggatcgttcccctgctgatcacgatcgttctcagcatcgctctgatcattcagacggaccagttcctgaaccgggaaaatctgttcaacctggtcgcgcaggcaatgccgctcgtcatcaccgcggtcggtcagctgttcgtcatcctcgtcggcggcctcgacctgtccgtcggctcgctgatcagcttcacgacggccatcctcgcgctggacgctccgggctacatcacgatcccggcagtcttcctgctggcggccctgctcggcctgaccaacggcatcgtgatcactcgtctcaacgtccatccgatcatcgcgacactggcgatgcagtacatcgtcctcggcgctgcgcgcatcttgcgtccggtctccggcgggaccattccggatgtcgtcatcagctcggtctcggggtcgttcctcggcatccccatgccgatattctggggcatttgtgtcgccctggtcgcctggaaactgctctacggctcgcggttcggcctgcatctcttcgcgatcggcggcggtattgccagcggcgtcgaagacgcgacgcgcaacttcggtgttgccgacaagcgcaacgtcatcctcgcctatgttgcctgctcgtgcttcgcagcccttgctggcgtgttcctggccggccgcatcgtttccggcgatccaaatgtcgggcttctcttcgaactcgacgcgatcaccgccgtcgccattggcggcacgcaactctccggcggcgtcggcagcctgcagggaacgattatcggagccctggtactggcgctcctctccaacggcatgaacctggtcaacgtttcgccgttcattcagacggcgatcaagggcggcatcctgctccttgtcgtcggtttccagacacgcaagaagatggggctctaagatgtcagccttcgcaaaaaatcccgcaattcagcgaatgcttaagattgcgcccgcctattatgtctttgcattgctgctgatcgtcctgtgggtctcgcgcccgcagatgctgaacgcaaatgtcatgggcatcttcattcgccaggtcgccccgctcggcgtcctcgttctcgggcagttgctcgtcatgcgggtcaaaagtatcgacctcgccggcggcggcgtcatcctgctcgtcaactacttcatctcgtccggccagtttcccggaatgtcggcgaccggtttcgtgctgctcgcgctcttcacgggcaccgcgatcgggctgttcaacggtttcatggtgggcaagcgccgcgtctcggctgttatcgtgacgcttgcggtcagcatcatcctcgttggtgccgtgcagttcctgtcgagcggcaagccgccgggtaacgtgccgagctacttcaacgatatctataacgtcaaactcggcccgctgcccctcccggtcctgttctgggtggtgctgaccacgctgctgtccctgcttctgtcgagaacggtgttcggccgttacgtgacctcggtcggcgcaaacgcggaagcagcgcatttctcaggcgtacccgtcgaacgcaccgtcgtcgtggcgcatacgctggcaggcctgatcgccggcatcgcggctctcgttcaaacggcttcgatcgcagtcggaagcgttcgcgtcggcctggatctgccgatcctttctgttgccgcaaccattctcggcggcgtggtcttcggccgcggcgaaggcggcgtctggggaccgttctttggtgtcctttcgttcgcgctcctctttgtcgtgatgacgtcgttcggcgtcagcgactccgggaagctcatcgcgcaaggcctcatcattctccttgcggccattttctacggcctcaaggcgcgtaccaactagtcgtcatcggaggagtaatgacatggcagaaagccgctcgatattgtgttttggggactcactgacatggggatggattccggtacccgagtcgtcgccgacactcagatacccctttgaacaacgctggaccggcgcaatggccgcagcactcggtgacggctatacgatcatcgaggaaggcttaagcgcccgcaccacgagcgtcgaggatccgaacgatcccaggctgaacggcagcgcctatctgccgatggcgctcgccagccacctgccgctcgatctcgtcatcatcctgctcggcaccaacgacaccaagtcgtatttccgccgcacgccttacgagatcgccaacggcatgggcaagcttgcgggacaggttctgacttcggccggcggcatcggcacgccctatcctgccccgaagcttctgatcgtctcgccgccgccgctcgctcccatgcctgacccatggttcgaaggcatgttcggcggtggctacgaaaagtccgtcgaactttcaaagcagtacaaggcgctcgccaacttcctgaaggtcgactttctcgacgccggcgagttcgtcaagaccgatggctgcgatggcatccatttctcggctgacacgaatatcacgctcggccaggcaatcgcagaaaaggtcaaggcgattttctctcaagaggcgaagaaagctgtggcctagcagcgttccgtcgccggccgccaggcgccatcctcccaggcggctggcggtccttttccgcaaacaagatttgaggctcccatgaccggctatgttctggcgatcgaccaggggacgacgtcctcccgagccatcgtttacggccccgatgcccagccgatcgcgatcgatcaaaaagagatatcacagtcgtttccgaagtcgggttgggtcgagcacgacgccaccgaaatctgggattctgttgttgagacctcccgtaccgctctcgcgcgagccggcatcgaggcgcgcgacgttgcggcgatcggcatcaccaatcagcgcgaaacctgcctcatctgggagcggtcgacgggcaagccgatccatccggcgatcgtctggcaggatcgccgcaccttcggcgcatgcgaggtccttcgcgcagacgggtttggcccgctgatacaggaaaagaccggccttctgctcgatccctatttctccgccaccaagatcgcctggatcctcgacaatgtcgacggcgcgcggcgtgcggccgagaatggccagctgctgtgcggcacgatcgacacttatctcacctggatgctcaccggcggcgccgtgcacgcgacggacgccaccaacgcgtcgcgcacctcgctgttcgatattcgtcagaatcgctgggacgacgaattgctgggcgccttcagagtcccgcgggctctcttgcccgaggtcaaggattgtgccgacgatttcggccagacggttgccgcccatttcggcgctcaaattccaatccgggcgctcgcgggcgaccagcaggcggctctgcttggtcaggcctgcctgaagcccggaatgctcaaatcgacctatggcacgggctgcttcgtggtcctgaacaccggcgatcagatcgtcagatcgtccaatcgtctgctgtcgaccattggctatcgcctcaatggcaaaacgacttatgcacttgagggttcgatcttcatggcgggtgccgcggttcaatggctgcgcgactccctgaagctcatcaaggcggccgacgagacgggccgtctcgcgcatctggccgacgaacaggaagacgtttacctggtgccggcattcaccgggctcggcgcgccgcactggaattcgcaagcccgtggcgcgattttcggcctaacgagaggcacggggatcgccgagctttcgcgggcgacgctggaatccgtctgctaccagacgcgcgatctcctcgaggcgatggcctccgattacccgatggacgtcaggggtgcgaccctgcgcgtcgatggcggcctgtcgggcagcgattgggccatgcaggcgctggccgattgcctcggaagcgtcatcgagcggtcgcaaagccaggaagcgacagcttacggagttgcggcactcgccggcgcgcaagcgggcgtctggcccgatcttcagacctttgccgcgaactggaaggcaaagcgcagcttcacccccaacctcaacactgacgagcgggcgcgacgctatcggaaatggcgcgccgccgttgcaagcacgctttcctatgcggcaacggcgtgacgttacgggagaccgacatggcagataagatccacgacctgttcgtaatcggcggcggcatcaacggttgcgggatcgcgcgcgacgcggtcggtcgcggctattcggtcgcgttggcggagatgaacgactttgcatccggcacatcatcgggtgccaccaagctcatccatgggggcctgcgttatctcgaacattacgagttccggctggtgcgtgaatcgctgatggagcgcgaagtgctctgggcgatggcgccgcacatcatctggccgatgcgcttcgtgctgccctaccagaaaggcggcatccgccccgcgtggctgatccggctcgggctcttcctttacgaccatctcggcggccgcaagctgctgccgccgacggcggtactcgacatgcgccgcgacgaggcggccaaaccgctgaaggcgctcttctccaaggcgtttgaatattccgacggctgggtcgacgatgcccgcctcgtggtgctcaatgcccgcgacgccagcgacaagggcgcgctgatcatgccgcgcaccaaggttgtctcggcgcggcgcgagaacgggctctggacgatcgagacggtggatacggtctccgggatcgcggcggttcaccgcgcacgcatgctcgtcaatgcggccggtccctgggtcgaccatgtgatccgcggcgccttcggcaagaatgaggcgcgcaacgtccgtctcgtccaaggcagccatatcgtggtcaagaagaagttcgaggggccgcgggcctatttcttccagaaccccgacaatcgcatcatctttgccattccctatgaggacgagttcacgctgatcggcaccaccgatcgcgacttcagcggcgatccgaaggacgtcaggatctcgcaggaggagacggaatacctctgcaaggcggcgagcgaatatttcaaggagccggtcaggcaggacgatatcgtctggacctatgcagggatccgcccgcttttcgacgacggcgccaccaaggcgcaggaggcaacccgcgactatgtgctgaagcttgacggcttcgtcggcagcgaggtcaacagggctccgctcctcaacgtcttcggcggcaagctcaccacctaccggcgtctggcagagcacgcgttggagaagatcggtgaggcgatcggcaccaagggggctccctggacggccaagagccatctgccgggcggcgactttccggttcaaggctacgaggcggaggtcaccaagcttcacaaggcctatccattcctcgccgcttcgcatgcgcgccggcttgtccgccgctatggcacaagagcatccgtccttctcggcactgccgggaaaatcgaggatctcggccggttgttcgggtccgatctctacgaagccgaagtgctctacctgatggcgcacgaatgggcgcgcacgacgaatgacattctctggagacgctcgaagaagggactgcatctcagccacagcgaagtggcccttctcgaccaattcatttctgagatcatccagcggcaggttgccgcgcagtgagatttttcggcgggccgtagcgcatcgatcatgccggccggccgcctgacatttgaggagttttgatgtcggacaagatttatccggtcaccaaaccggtggagagccatgcgctgatcaataaggccgagtaccaggaatggtacgaggagagtgtcgctagccccgagcagttctggggcaaacacggcaagcgcatcgactggttcaagccttacacccgcgtaaaggacacctcttttaccggggatgtctcgatcaaatggttcgaggacggtgagaccaatgtctcctacaactgcatcgaccggcacctcgcaacaaacggtgatcaggtcgccatcatatgggaaggtgacgatccatcgctcgacaggaaggtcacctaccgcgagctttacgagcacgtctgtcgtatggcgaacgtcttgaagaagcacggggtcaagaagggcgatcgtgtcactatctacatgccgatggtgccggaagcggcctatgcgatgctcgcctgcgcccgcatcggcgcaatccattccgtggtgtttggcggcttcagtcccgaggcgctgggtggccgcatcgtcgattgtgaatcgaccttcgtcatcacctgcgatgagggcctgcgcggcggcaagccggttccgttgaaagccaatgtcgacaaggcgatcgacatcgccgcgcgcggtcatgtcatggtcaagaacgtgctcgtcatccgccgcaccggcagcccgctcagttgggcgccgggccgcgacctctggcatcacgaggaagcagccaccgtttcggccgactgcccgcccgagccaatgaacgccgaggatccactgttcatcctctatacttcaggctcgaccggcaaaccgaagggcgttctccacaccaccggcggctatctcgtctacgcctcgatgacccacgaatatgtcttcgattaccagcacggcgatatctactggtgcactgccgacgtcggctgggtcacgggacactcctatatcgtctacggaccgctcgccaactgcgcaacgacgctgatgttcgaggggatcccgacattccccgatgccggccggttctgggatgtgatcgataagcacaaggtcaacatcttctataccgccccgaccgcaatccgttcgctgatgggcgccggcgatgatttcgtcaaacgatccagccgatccagcctgtggttgcttggctcggtcggcgagccgatcaaccccgaagcctgggaatggtactatcacacggtcggcgacgggcgctgccctgttgtcgatacctggtggcagacggaaaccggcggcatcatgatcacgccgctgccgggtgcgaccgacctgaagccaggctcggccactcggcccttcttcggcatcaggccggagctcgtcgatgccgaaggcaagcccatcgaaggggccgccgacggcaatctctgcatcgccgacagctggccaggtcaggcgcgttccgtctatggcgatcacaagcgcttcatccagacctacttctccacctacgagggcaagtatttcaccggcgacggctgtcgccgtgatgccgacggctattattggatcacaggtcgcgtcgacgacgtcctcaatgtctccggccaccggctggggacggcggaagtcgagtccgccctggtttcgcatcacctcgtgtccgaagccgctgtcgtcggctatccacacaacatcaagggccagggcatctattgctatgtcacgctgatggcgggcagcgaagggtccgaggagttgcgccagcagctggtcaagcatgtccgcgcggaaatcggcccgatcgcgtcgcctgataagatccagttcgcgccgggcctgccgaagacccgctcgggaaagatcatgcgccgcattctgcgcaagatcgccgaggacgatttcgggtcgctcggcgacacctcgacgcttgccgatcccgctgtcgtcgacgatctgatcgtcaaccgccagaacagggccgaggcggcctagaccgaaggaaaggactatcccatgagactgatcctgatgggcccgcccgggtccggcaaggggacccaagccaagcgcatctgcgaaaagctcggcatcccgcatctatcgaccggcgatatcctccgggccgaggtcaaggcgggaacgcccctcggtttggcggtcgcggccaccatggcagccggcgggctcgtttccgacgataccgtctcggcgatcgtcgccaaccggattgccagtccggaagctcagcgcggattcgtactcgacgggtttccgcgcacgatttcgcaggcggcgtcgttggatcaatcgctcggggagcattccctgactgctgtcatcgagctcgtcgtcccggaggaagaactttacgaccgcatctgccgaagggcggcagagtctgccggcgcacaacgcgccgatgacaatgcggcgacattggaactgcgcctcaaggcgtatcgggccgagaccctttcggtgagcgagttctacaagggtcggtcgccctactttcaggtcgacggcctcgccgttcccgaggaagtgaccgcccggattctggagatcctggagtcggccgcggccgaatattcctgagacattactaattcgagatcaattttaccggatattcattcactcagaataattattatgggacctcgttatcttgggtggagaatcatgagcattcattttgacttcctgctgttgcgcggaccgatccggactaaaatcttttgtctgctgacgccgatactgatcggcatcgcaggcttgagcctcgtcaactatctctcaggcaacatgctgaatacccagctcgcgagcagttcgagcgggatggtcacgctgtctgcgatcaaacaagcccaggacgggatgaactccttcctgctcgaggcgaccgaggccaagcgcgatgcgctgaaggcgctgctcgcagaccagagcgctaagatatcgacgagcctgtccttcgctcaagagcaggatgaacggcagagcctggttgccgccgggacgattgccgaagaggtctccaggacgatcgacggcctctgggacatgcacagcgacgagaggaaactgcgggaagggatttccagcgatctcgcaaccctgtcggatgtgcagtccaaactgcagacctatctgaacattcccgccgatcaggcggcagcacaagcggcgaccgccgaaacgctgaacaagatcaattccatgaactacgaacttcggatcgccgcttccgactttctgggtggaatgaacgacgataccctcaagaaggtgaagggccgtctcaagggcctgggcttctatctgggcaaggtcaaggaacagcatgccgccaacggtcctatccaggaactggccagcaaagccatcgacgtgatcggcgggacctcggagaggttcgaccagctcctcgtcaaggtcggagaacgtgacgccgccttcaaggctgcgagcgccagcatgaatgacgcctggaacaagatccttctattcgccgacatccagcgcggccatgcctccgcggcccaagaccaggcgcaaaccatatccttagtgacgaccgtgatcgccctgctcttcggctgcgtcgccggctatctgctgctcagaaccatcaagtctccgatcgaagcgctcacggcctccatgaaggcggttgcatcaggcaagctcgatgaaaagatcggcagcgtcgaaacgcgcgacgagatcggcgagatggcaagggcgcttgatgtctttcgccacaacgcgctcgaaaagatccgcgtggaaaatgaggcggaacagtcgaggtcactcgcgcgccaacagcgccaggaagacgacctccgcaagacccgcgatgcggctgccatcagtaacgctgtcgaggcggttgcatccggcctgcacaagctggcgagcggcgatctgaccgtgaccatcggccgtcccctcgatggtgagctcgatcagcttcggcaggacttcaatgcctcgatgctgcacctgcaggcgacgatgcgccagatccgcgacaatgtcgaaatgatccagggcaacggcaaccagatggccgaggcggccgaggatcttgccaaacggactgagcagcaggctgcttcgctcgaagaaacggcagccgccgtcgacgagatcaccgtcacggttcgctcgtcggcggaacgtgccaaggatgccgaccagatcgtccgccaggccaagcagagcgccgacgattcagccatcgtcgtcaacaatgcgatcgatgcgatgggccggatcgaagaagcctcccgccagatcgagcagatcaccggcgtcatcgacgagatcgccttccagaccaatctgctggcgttgaatgccggcgtcgaggcggcacgcgccggcgatgcgggcaaaggctttgccgtcgttgcccaggaggtgcgtgaactggcgcagcgctccgccaaggcggccaaggagatcaaggtcctcatcaacaagtcgacggccgaggtcaataccggctcgcatctggtccaggaaaccggttcggtccttgcgaagatcagctcgcagatcgtcacgatcagtcagcatgtcgagacgatcgcccgcggcagccacgatcagtcgagtgcgctgcagggggtcaactcgaccgtcaatcagatggaccagatgacacagcacaatgcggctatggtcgaggaaacgacggccgcgagccgcgaactcgcctctcaggccgacagcctgctggccctggttcagcaattcaggatcgaaggaaatgcacgagaatttgggttctcaaacgccgaggagttgtcgcaccaaagaccggccagccagagcgcggcgtgaggtcgccaccgaattacattggccggacagaactgcgtctgaagcggagtaacgaaatcggatctcactggatttacgagacaggttgaaacatcgacatgacaatcacaccggacatagaacttggcgcttatctccacgagacgaaagtcgatcctgccctggcaagcttggttgaaagcatagcagcctcagcgatcgttgttgccgatcacctgaaggaagcagcctttcagaaccatataggcagctccggcacgacgaatgtccagggtgaagatcagaagctcctcgatgtcctggccgatcgtgtgtttcgcgaaacatgcggcgaggcggtctcgcttgctgcctatgtttccgaggaggcggaggaggtcacgtggttgaaacctccagccgctggcgacctcatcctttacgtcgatccgctggacggctcatcgaaccttgaagtcaacctttccgtcggttcgatctttgcggtgagtcaggtccaggcggacggcgacaccaatgttctacgcaaggggcgagagtatctctgcgccggctatgccatctatggcccctcgacgctcttcgttatcacattcggcctcggcgtggtcggcttcacgctggatccgtctgacgggcaattcaaactgaccaacgcgcgcatgcgcgtgccgacggaaacgaccgagtttgccgtgaattcgtcgcgccagcgtttctgggatgagccgatccgacgctatgtcgacgaatgccttgcgggatcggcagggccgcgcggacaggacttcaacatgcgctggaccgcctcgatggtggccgacgtccatcgcattctgacccgcggaggggtgtttctctatccggcggacgagtccaatcgccgcgccggcggcaagctgcgcctgatgtatgaagccaatcccatggcgttcctcgtcgaggcggccggcggtgcagcatccaccggaaccgaagacatccttcgcatccaaccacaggctcatcatcagcgcgtgtcggtgttgctcggctcgagcaacgaaatccaacgcctggtgcaatttcaccaaatccatcactcgcaagaggagatcggctcttaaatggctctcgtcacccttcgtcaattgctcgaccacgccgccgagaacggctacgccatcccggctttcaacgtgaacaacatggagcagatgctcgccatcatgaaggctgctgatcgtaccgacagcccggtcatcatgcaggcaagccgcggcgcccgagcttttgcaggcgacgcgacgctgtcgcatctgatccgtgcggcgatcgagatgtatccgcatatcccggtgtgcatgcatcaggaccacggcaattcggcgtcgacctgcatgtcggcaattcttgccggcttctcctcggtgatgatggacggttccctctctgaagatgggcgcacgcctctcagcttcgaaaataatgtcgccgtcacggccaaggtttcggagatggcgcatctggtcggcgtctccgtcgaaggagaaatcggccatctcggctcgttggaaagcggccgcggcgaagcagaagatgggcacggctttgacggcgagctcagccgcgacatgcttttgaccgatccggaagaggctgccgagttcgtgcgcttgacgaaggtggatgcgctcgccatcgccatcggcacgtctcatggcgcttacaaattctcccggaagccggacggcgacatcctttccatcaagcgcctgaaggagatccacgcccgcctgcccgatacccatctcgtcatgcatgggtcgtcgtccgtgccccaggaattgcaggaactgatcaacgcgcatggcggcgaggtcaaaccgacctatggtgttccggtcgaggaaatccaggaaggcatccgccacggcgttcgcaaggtgaatgtcgacaccgaccttcgattggcgttcacgggggcgatccgccgcgtctttgcccttcatcccggggagttcgatccacgcaaatacctcgccccgggcatcgaggcgatggcagcggtctgcggcgaccgatacgagcagttcggcgccgccggacatgcctccgccatcaagcccttgccgcttgccgagatggcgaagcgatatagccactaaccgggggcaagaacttgagtaacactccccgccggctcatcgtcggcaactggaaaatgaacgggcttacggccgatctcgccgagatcgaaaaggtcgcctggaacatcggcgagctgaatgcggatgtggctatatgtcctccggcaacgctcctgcaatccgccgtgaggataatcgccggaagccggcttcttctcggtgcccaggattgcagcgctcaggaagctggcgcccataccggcgacatatccgccaggatgatcgccgattcccgcgcccgcgtcgtcatactcggtcattccgagaggcggcaatatcagggcgagacggacgcgatggtcaggcgcaaggccgagattgcggtgagcgccggcttgatgccagtaatttgcgtcggtgagacagaagcggagcatctccgccaggagacgcttactgtcctcaaaaaccagctgcagggttgcctgcccgccgaaatgaacgagctcgccttggtcatagcttatgagccggtctggtcgattgggaccggtcggctgcccgaacaaagcgaaattctcgccgcccatgcctgcatccgatccagtctgatcgatgcctatggatcgatcggtgcacagctcaggatcctctatggtggatccgtcaaacctgagaattcggccgagattcttgctcttgaaaatgtcgacggtgttctggtcggcggcgccagtctgcgcgcggaaagctttcttcggatctgcgaggcaaccgggaggtaggtcaccagtcgttccgctgcggaagtcaggggcaaacccatcgggcggatcgttcgccctgttgctcgaggatgaaaataaacaccaacgaaagcaggttggtcatggaacattggatgctttcgcccatcgaaaagacctgccttcgatgggtgtcgatgggaaagactgttgatgaaatcgccctgctccaaggcagaagcgtcattgaaatcgaaagctatctcgagcaagcgcttgctgcactcgaggcgagttcgatgcaggaggctctcgagaaggcaagcctttcggagcccgactgatgttggccgcagggcggcgagcagcaaacccacgacctttcaacgacagggatggcgatgaaatgaccaatcatgtgaacaatcagagcaaggccaaagcgccgagcccgatcgatgtcgaggtgggagcaagcgtgcgcggaatgagccaaagcacactcgccgaggctttgggcgtgacgttccagcaagtccagaaatacgagaagggcacgaaccgcgtcggcgcgagccgtttgctcaatgtcgccactctgctcggtgtgccggtgtcgtatttcttcgacagccagagccgtgatggaaaacccgatgggctgacaggcaccggcgccgagatggagctcagcgccttcctcgataccgacgaggggcgagacctcaacgtcgccttcgccaggatagcaaggccggcactgcgccgtcaggtcctatccctcgtcaaggccatggccgcgacggatgtaaagggttcccgcgggaacgcctagtttggtgccgctccggttatgcggcgaaactcaactcctggagatgcccattgcagcatgctgcactccgacatggcaacatcgcgcaggccggcccggttggtcagctggatcgcgatcacgtgtcttgcgtcggggacagccattacatcgtcggccggttccacgcctggaaaggaaagtgccattcagccctgaagctggcgttcgatggcgcgccagacgcttatttgctttacctgcccctatccaccacgcctgggacacgttcgggggcactgcgcctttcgacggcacaggcagttggttttctggaggatctcgctcagttcgatgagctgacccctcatgaacattccagctatatcggcctctccttcgcaaagtcggcgatggtgcaacaggtcagtgaactcttggatgggcctgtcacggcagaccttcatttcgaccgcatcgtcgatctgaccaccgagaagggtctgcggctggccgcactcggccatctcgtatggagctgtcttaatctttccgacgcggatcgattggcgccggctgccatcgagcggctgtttgagtcgacgatgatcgcacttctggaggttgttcccaatagctacatgccgcggctcgagcggccggtctcgccggcggtgccccggcaggtgaaacgggcgatcgagtatatgcatgccaacctgtcgcaacctctcactgttgcgtcgatagccagcgagaccggtacgagcgtcagagcattgcaggtcgccttccagcggttcaagggcacaacgcctttgggctatctcaaaacgatccgcctcgaagcagcgcgccgagcgctggtcgacgataccggctcgcggtcgatcgccgacgcggcacgcagtgcagggttcacccatatggggcggtttgcggccgtctactatcaggcttttggcgaaacgccgtcggaaacgatccggacgagatagattgccagtcaacggcaatgtcgaaagcggaaaccatcttcgtgttgcggaagtcagccgcgaaactggcatggtatgaaatgcgtgcgcgaaccgttcatctcccccggaagcagcccaatcccgctcttttgtgatggcgtcctggcccggcgccggatcttccacgatcaacccgttaagggtccgctagcaagctgcggccgcttcggcttcgcctcgcggtgatcgcgcccgtcgccgggccttttgaggagccatcgagcgggattggcccgctcccgcaggagcctcttatatgtcgcacgatctttccctcgctcagtcccacgccttccagctttcccgcgacctgatggtcccggtcaccgtcttcgaagtcgacggcgaatatggcgtcctcccttctgacgagatcgacgccggtgacgcccttgagatcgtcaatgagttcttcccctggccggctcattgagccggccgccagtgccttcggcgtgccgcttgcgcgcggcaggccgcaagggaggctgcgccgcggccgggtattgcatgatccgacaattgtcagccgcgcccttgcggcctttgctcttcgcggcgggtggagcgcgcctgcgaagcgacgggcaagaaaggcaatgaggaaaagcatggacagaaaggaaatagaggcgctgcgcgaccaggtgagctgcgcggctgttcttgagcaggcgggcttcgccatcgatctaaaggagagtacccggcgggcggtgaagttccgccggtcgggcgaaattatcatcgtcacccatgacggtcgcggatggttcgatccgctcggcgatgcgaaaggcgatgtgttcggacttgtcgaacatctcgatcatgttggctttctcgaaggcgccggaagggtcgccggccttgttggttttgcgatcacggagccggaatggcaggcgccgaggcctgaccgagacctcgatctttctttacccgagcgttggcaggcacgccgccggccgtggcccagctcgtcgacatgggcttatctgaacggtgagcgcttccttcctgccactctgctccgagccacgatcgggcaagaccgtctgcgggaaggcccgcaaggcagcatgtgggcagcgcacaccgacaatgccggagttgtgaccggctgggaggcgcgcggtcctgaatatcggggatttgcctccggtggaacgaaggtcctcttccgtctgggaccggacccagcgttgcgcctggccgtgacggaagctgcgatcgacgccatgagccttgccgccatcgaggggctgcgcgatggaaccgtgtatctcagtaccgggggcggatggtcgccgtcgacggaggcggcgcttcggcagatggcctcgcgagcagatagtctcctcgtcgccgcgacagacggcaatccgcaaggagagatgtttgccgagcgcttgcgggcgctcgcggataccgtcggctgcgactggtcgcggctccgcccgcccgaggaggattggaacgaaaccctgaaaatcagggagaaagaaaagagggaaaggaaggaaggcggcgtgccgcattcgcgccgcccgcgtcaagggaagcttcgcccgggcgagccggcccttgacccggccggtcgcgatgccggcggcccgggaggtgtcatgaaggactgaagaggatggcaaggtcggaaggacagtgccgcacttcggtccggaaccatctccaaggagccgcagatgtatccctctcccgcaatccgcaaggtcttccacggcgttgcctcacgccagcaaatgttccggatgttcgatcggcacgctcaacgtccgaaccgttgggacggtgacgcctcgctcctctattccggcgaatggttcgagatcgccgagaccgagcacgactatatgttcgagatcctgccaccgctctggatccgcgggtcgatgttcgccatgcgcgagtatctgacgggttcggtgacatcagtgttcttcgcattgcgcatcgatggtgtcatccgacatttccacggctattgcgatctatcggacaaaggcgccgtcgagcgcatgcgcgtggcaatcatcgagcgtgagagccggccggtgcgcgccatgacgcgcgaggaacgcctggagcatatctggagcatcacggcggacgactatcgtggctatgccggcgatcgctgggacgaagctgcgcgcggcaagcgcacgatcatgctctacggcggcgcagtgggcagcactctgaaactgctcgacgagctgaccgacgacgagatcgcggcgaagctgccggtgcagctgcgccacctcccctcgccgattgccgcatgagggaggcacactatgctttccttcccgcttacatccgtccgcgaggtcgtcgcccgcagtcgtgccgacgccgaagccaatggcggctttcgtaacccctactacggcctgcgccctggcaaggacgagaagcccggcctctggctcgtcggcgaccaaggagtctacctcctgtcgaacggcaagctgcccgatggcgccaagcctttggtcgtttatgccgaggaatgcgatccccgcaccaatgacgactggttcgcagtcaaacgccggacattcggcggcgatgacggagtcgatttcgtcgatgcggaacagctcgaagcgatgatggcggccgcgccggaggcgacgcacctgcgtatcgcattccttcaggactcgatgcagctcttcctggtcgcgaagccctaggcaattcgcgaccagtccggcccgtttggccacctatcccaaacccttgagctccctttaatccccgcaagtgcttcccgcggggtgatgacgctcgccattttccgaggaaacctccatgagcaacgatcccttcactctcgacatgttcggcagcagcgcgctgtcatcaggcctcggcctgggcgtcacaccgttcggcggcttcgatacggtcgcggccaacgacgatgacccggaaccgacgccgccctctccctccccggccttgccggccgcggcgatagaacgtccggcgccccggcgccagggcaaccggtgcaacttctacctcgacgatgcggatcggggcttggccggatcctggaaggatcgcgctcgcgccaatgttgcggcgatcctgatcgcgaacaacatcgagaagcaggatcggccagccaacgcgaaggagcaggcgcaactcatccgcttcaccggcttcggcgccagcgaactggcgaacggtatgttccgccgccccggcgaagtcgatttccgggccgggtggggcgagctcggtggctcgctcgaaagtgccgtttcagatgccgactacgcgtcgctcgcccgctgcacgcaatatgcccatttcacgccggagttcatcatccgggcaatctggtcgggcttgcagcgcctgggctggtgtggcggccgcatgctcgagccgggtatcggtacgggcctgtttccggctctgatgccggcggcctttcgcgacaggaccttcgtcaccggcgtcgaactcgatcccgtcacggcccggatcgtcaagctgctgcagcctaaggcccgcatcatcaatggcgattttgcgcgcgccgatctggcgccgatctacgatctcgccattggcaatccacccttctccgatcgcaccgtccggtctgaccggacctatcgctcactcggtctcaggctgcacgactacttcatcacccgttcgatcgacctgctgaagcccggcgcgctcgccgcgttcgtcaccagttccggcacgatggacaaggccgacgcgaccgcgcgtgagtacatcgccaaaaccgccgacctgattgccgcgatccgattgccggaggggagtttccgccgcgatgctggcacggatgtcgtggtcgaccttctgttcttccgcaagcgcaaggtcggcgaaccgacaagcgatctgtcatggctcgatctcgaggaggtgcggcccgaaagccaagacgagggcgcagttcgcgtgaaccgctggtttgcagagcatcctaatttcgtcctcggcgatcatgccctgacctccggaccgttcggcgagacctatacatgccagccacgcgctggcgaggacctgcaggcggctctaaagaacgtcgttcgcctgctgcctgaaggccgctatgacggtgagccgaccgcaatcgacgtcgacctcgaggacgagctcggcgagatcatcgatcttcgccccggtgacgccaaggtccgtgagggtagcttcttcatcgataacaggcacggcctgatgcagatggtggacggcgcacccgtggaggtcaaagtccgcaaggggcgcaccggggacggcatcccggaaaagcacgtcgggatcatcaagaagctgatcccaatccgcgacgcggtgcgtgaggtgctgagggcccaggagcaggatcggccgtggcgtgatctgcaggttcgcttgcgcatcgcctggtcgagcttcgtgcgtgatttcggtccgatcaaccacaccaccgtctcgatcagcgaggacgaggaatccggcgaggtgcgcgaaacgcaccgccgtccaaacctgcagcctttcctcgacgatcccgattgctggctggtcgcctcgatcgaggactacgacctcgacaccgataccgcaaaaccgcgcccgatcttttccgaacgggtcatcgcgccgcctgcgccgcccgaaatcaccagtgcggcggatgcgttggccgtggtgctcaacgaacgtggccgcgtcgatgtcgagcatatcgccgaactgctgcacagacatgccgatgccgtcgtcgacgagctcggcgatgcgattttccaggatcccgccgatggctcctggcagacgtcggatgcctacctctccggtgcggtccgcaccaagcttggtgtcgccgaagctgccgcggcactcgatccagcctacgagcgtaacgtccgcgcgcttcaggcagtccaacccgccgatcttcgcccgtccgacatcaccgcacgtctcggtgcgccctggattccggccagcgacgtcgtcgccttcgtgaaggagatgatgggtgccgagatcaggatccaccatatgccggaattgggcagctggacggtggaagcacggcagcttggctactgcgccgccggcacatcggagtggggcaccagccgccgtgatgccggcgagttgctcggcgacgcgctgaacagccgtgttccccagattttcgatatctacaaggatgccggtggcgagcggagggtcctgaacgtcgtcgataccgaggcggcgcgcgacaagctgcagaaaatcaaggaagccttccaaaactgggtttggaccgatccggatcgcaccgaccggctggcgcgggtctataacgaccggttcaacaacatcgcgcctcgaaaattcgacggatcgcatctgaaacttcccggcgcctctggcgcctttgttctttatgggcaccagaaacgcggcatctggcggatcatctcctccggatcgacctatctcgcccacgccgtcggcgcgggcaagacgatgacgatggcggccgcgatcatggaacaacgacgtctcggcctgatcgccaaggcgatgctggtcgtccctggtcattgcctggcgcaggcggcgcgggaatttctggcactctatcccaatgcccggatcctcgtcgccgacgagaccaacttcaccaaggacaaacggcttcgctttttgagccgggcagcgaccgcgacctgggatgcgatcattatcacgcactcggccttcaggttcatcgccgtgccgtccgccttcgaacaacagatgatccacgatgagttggagctctacgaggatctgctgaccaaggtggacagcgaggaccgcgtgtcgcgcaagcgcctcgagcgactgaaggaaagcttgcaggaacggctggaagggctcgcgacccgcaaggacgatctgctcacaatctccgagatcggtgtcgaccagatcatcgtcgacgaggcgcaagagttccgcaagctttccttcgcgaccaacatgtcgacgctgaagggtatcgacccgaacggctcgcagcgcgcctgggacctctatgtgaagtcccggttcctcgaaacgaagaacccgggccgcgcgctggtgctcgcctccggcacgccgatcaccaacacactcggtgagatgttctcgatccagcgcctgctcggccacgaggctctcgccgagcgcggcttacacgaattcgatgcctgggcgtcctgcttcggcgatacgacgaccgagctggagatccagccgtccggcaaatacaagccggtcagccgcttcgcgagcttcgtcaatgtgcccgaactgatcgccatgttccgggctttcgccgacgtcgtcatgccggcggatctccgcgaatacgtcaaggtgcctgatatctccaccggccgacggcagatcctgaccgtcaagccgacgccggcgttcaaggcctatcagcagatcctcgatgcccgcatcaaggcgatcgagatgcgcgagggaccggctgagcccggcgacgatatcctgctctcggtcattaccgacggtcgccatgcggcgatcgatctccgcctcgtgataccggccaacgacaatgaggaggacaacaagctcaacctcctcgtccgcaatgccttccgcatctggcaagagacgagcgacgatacctacgtccggccggacggcaaaccctttgacctgcccggcgccgcgcagatgatcttcagcgatctcggcacgatcaacgtcgagaagacccgcggcttttccgcctaccgctggattcgcgacgagtttgtgcggctgggcgttcccccgtccgaaatcgccttcatgcaggactacaagaagaccgaggccaagcaacggctcttcgccgacgtgcgcgccggccgaattcggttcctgatcggatcgtcggagacgatgggaacgggcgtgaacgctcaagcgcggctgaaagcgctgcatcacctcgatgtgccgtggctgccgtcgcacatcgagcagcgcgaaggccgcatcgtccggcagggtaatcagcacgatgtcgtcgacattttcgcctatgcgaccgagggcagcctcgacgcttccatgtggcagaacaacgagcgcaaggcccgcttcatcgccgccgcgctcagcggagatacttcgatccgccggctcgaagacttcggtgaagggcaggcgaaccagttcgccatggccaaggcaatcgcctccggcgacgagcggctgatgcagaaagcgggtctcgaagccgatatcgcgcgactggaacggttgcgcgccgcccatgacgatgaccagtatgcggtgcgccggcagatgcgcgatgccgagcgtgacatcgagacgtcgacccgccgcatcggcgagatcggccaggatatcggtcggctcgttccgaccgccggcgatgccttcgcgatgaccgtgctgggcaagcttcaccatgagcgcaaggaagccggtcgcgcgctgatgaaggaggttctcacgctcctccagctccaacaggagggcgaggttcacctcgcatctatcggcggtttcgatcttgtctatgagggagagcgcttcggaaagggcgacggctatcgctacgccaccacgctccagcgcacaggcgccgcctacgagattgaccttgcggtcacagtgacaccgctcggcgccatctcccgcctcgagcatgcgctcgacgggttcgaggaggaacgcgagcgttatcgccatcgcctcgatgatgcgcaccggcggctcgtctcctatcgctcgcgcgaaggcggcactttcgccttcgccgacgaacttgccgaaaagcgccgacagcttcgtgacgtcgaggacgctcttgccgccgcgtcagttcagaacgacgccgcctcggcggagtctgcttgaatggaatcgcggttttgatgcgacgcagcatttgcatagctgcattgcacaatatttgctttccttccgaccgaaatttgagcatagtgctcacagctgatgcacatggcggttttcctcccagtgccgccgcagcagctgttcccctctggaggtttaaattaccttcatacctatagggcccgagttttctcgtggccctctttttttgtcctgatttccgttcatcgaagcgacccctacgacggtcatcctcgtcgcggttttcccccgctcaggtaatcacctcgacgcgctccatcttttcgatcagccgcccgctcatatcctccgggtcgttcaggacggtcacgaagtcggagaggctcggattcttcaaaccgactttgtagatcgcaaccccgcttcgacattctcgtccatggccttcagcccctcgaaatgtcgggaggcctcctgccaggcgagccccaaagtctcggtgaacgcaaggatctcgtctgttcccggaacgacctgataggcaaatatctcttttgtatcgtgcatcgaaacctccttgagctgcgacagcctaaggcgcgtttccggttgctgtgaactatcaaaagtgtgagcggcagtttccggaaggagggaggacaaaaagaaggaagagggaaaagaaaccggtcgcagatcggtcttccagtcgccgcttgcgctcaaccgccgcctgcgcatcccggccactcgtcccgcgcagggctgttagccccgctcggacatcgcagcagggacgctcggccgcagttgcgccgggccgcccgccccgcggtccgggaggtgtcttcgaaagaaacgaagacaggaaggaccggcaagcgagccgtgtcccgcatctcggaagaggaaaatcccatgcacatcatgaaggtcgatccgcgctcgttgaaggacaacccggacaatactcgtcagtcgaaatccaccccgcaggctgatgcgctgctgctcgcgaccatcaaagccgtcggcatcatccagccgcccgtcatctttccgcaaagcgatggcggaaacggctacgtcatcgaagccggccatcggcggacccgcatggcgatcgccgcgggccttgaggaaatcgaggttctcgtggtcgaagccgctaacgataatggcgccatgcggtccatggtcgagaacatcgccagggagccgctcaaccccgtcgaccagtggcgcggcatcgaacgcctgatcgcactcgactggaccgaggaagcgattgcggtcgcacttgccctccccgtccggcagattcgcaagttgcggctgctcgccaatgtctttccggcgatgctcgaccaaatggcgctcggcgacatgccgaacgagcagcagcttcgaacgatcgcggcggcacacctcgatgagcagaaggaagtctggaaggcgcagaagccgaagaagggccagcctgccacgtggttccagatcgccaacgcgctgagcaagacccgcatgtacgcaaaggatgcgagcttcggcgacgatctcagggaagcctatggcatcgaatggatcgaggatctgtttgcccctgccgatgaggacagccgctacaccaccaacgtcgaagcctatctcggcgcccagcaggagtggatgaccaacaatctgccgaagaagggcgtgatcgccgaggtcacgcaatggggtgacgtaaagctgccgcagaaggccagccgcgtttatggcaagccaggcaagggcgaccacaccgcaatgtacctggatcggaacggcaaggttcagaccgtgcattaccggatgccggaggagaagaagacggcgggcaagagagcggtcgttggaggtggtgccaccgctggcgacgatgtgatcgacgcgccgaaacagcgtccggatgtcacgcaaaagggccacgacatgatcggtgacctcaggaccgacgcgctgcacgaagcgctcgctcgcgcgccgatcgaggacgacacgctgacggcgctcctcgtgctcgccttcgccggcttgaatgtacgggtcgactccggggcaaacgacaccgtcttcggcacgaagcggttcgctcgccatgcggttcggttgctcgactctgacggtaagctgtccttcgagatcgacacgttgcgggttgccgcccgctcgatgctggtcgatgtgctctcttgccgccgcggcatgtcgaacagcgggatcgtgtcacgtatcgccggcgaggccatcggcgccgatggatatctcccgaacatgggcaccgaagatttcctgctttgcctgtcgcgggcggcgcttgaggcgtcgtgcaaggacaccccggttctgccgcgcccgaaggtccgcgagacccgcgcagcactcgtcgagcacttcaaggaagggcacttcgtccacccggcagccctgttcgcgcccgatccgaaggaacttgccgacctgatcaagaaaggcgagatcgtcgaagaggaggacagcgtcaccactgaagaaacgagcgatggtcttggcgaactcgcggacgacagcgccgccggcgaggccgccgaacttgacgcccccgatccggaggccgacgacggggctcctgacgaggacgaaaccgcctacggcattgcggccgaatagcctcccttcccttctcatccgatcgacaaccgccgccggccatcaccggcggcggcttcgtttccatgaaccgcagaattccaaggagatgtcttatgtctgcgtccctgatctacgacctcgccccgatcggctccatcgtcgcctggtccgacggcagccctcggccgcccgagcgtttcaagaagaagctggcggcctggcaaacccgcaacagcaaaggccgcctgatccgcaaggagggtccgcgccaatccggaaattacgcctcgcccgggcatttcacgctgcatgaggctgatttcggcggaaagaataccgtcgtcatgcgcattcaccgaaccttcggtctcgattccgatctcgccttcaaggttctcgaacgccccgcactcggttctatccgcctcttcgatcgcgccggtgcgaacgcggagcttgtccatctcgccggcaatcacgaggcggcggtggcctggctgaaagagcatggatacccgaatgccatcctcgaagaggtgaccgccgacgaggtcgcggcggctcatgtcgaagggagggttgccgcatgagcacgcccgatcttcaacacgacagggttcctaccgccgacgactccgcggtgaaattcggcgtcagcgcggacggctttccggtcgcccggatcgccgataccttcctggcaatggtgccggcgcgcgatggcgccagcttcctcgcgagcgcctggcgcctcactcgcccgctgtcagagctgacgcgggaggatttccacggtcacgaagggcgcctcgaagatgagacagcgttccgcgcgcgcgtgttcgagaccgcgcggcacagccatgaactatccgcgctcgggcggatccagagccgcatggcagcgactacgccatggggtctgtcgcagctcgcgacgatctacgccgaggggatcgtctcccatatgaccgccggtcatggcgggtttcatctgtcggccgaacggaatgcccgcgtccttccgatgctgcgaaagtccttgccctggtacgaggaggacgcagaatgggcgattgtcgccctcaccttcccagatctcttcacgtcctacgagcgcaaatgtgccgatgagacgatccgcaatagctggccgtccgcctgggaggcgatccacggccgcgaactccagcccggccaatcctggacaaaggaccgggaagccttcgagcgcaagcatgccggcgactggatcgtgatctccgcgatcttttccagccgccatgccgacatgacggaggtcatcgccacgcgaggcggccggcgcgatgggcgggtggaggagatgcgctttctcgtgccccgcgccgagtatgccgcgcgcgaccgcttcggtttcgtcatcgatcctgaccgtcataatccctgtgacggtccttccagttttgtggggtggcaagggagggatgcgtgatggctgcaatgccaatccaccatgcgcaactggcgcgtatggaagaagcgcggcggcagacgcagcgccagctcgaactgatcgatcgccaggtcttgcgccggataacatcgatcctgccacagctcgcgcgccggcaaaccggatatcggcgcggaaaggcgccggatacgggcttcttcctcgaacgttatcgcaacaatctcgccgccctgacagcggagcgtcagccggaagttgacgcgctgacacgaaagttggctcggcaggatgcagcgatagccgcctttcgcaaacggttcgaacccgttggcgacgcggctcagccacgagcggaggtctagcgacatgggtacgatcggagacctcgaacggagcgccggcattgggccatcgtccgcggaacgcaccgcgttctggcagcagttccaccacctcaacggaaaggcgtgcctcgacgcgggcgttgcggagcttaaacgaatgatcgccgcgagggaggaacaggctgacgttgcctcgagtaagcagcgcgctgttccgaagcgcgaaagacttcctcctttgagcggtgaacaggaagccgcgctccaggcctatgccgcaagacacgggcgtcgctggaagagcatcctgaacaacgtctggatgggtggcgcgccctatgacgatggcgggacactccgcggtcttcgaaacacgcacggtccgagctggctgcaatattatcggctgcccaagccgaaaccctcggccgagaccatcatcgcgccaattgagcgtgcggcgagttcgggaagtgacgacgtatagcgtcccggcagccatcttcctttcagtacctggttggaccagaccccgtgccgatttgcccttcggttttgctgcggtctgaaccagcggccgttcgcttcaaggccgctatccgcgccgcccggcggccggaggcgccgtccctcacggagcaggcttgcgggcctcgcagggcaggatgccccgcttgcccgcaaaccggctccgctcagcctgtcgtctccggaccttgaagcgcccgtcttccgccggttcggggcgaccgcaccgaagggcaaatcggcacggggccggagccgcttcgaggttgaaaggaagaaatcatggcaaagcccgctacctcccctcgtcaatccgctcgcgtcgtggctctgcgcaaaggcgcaaccgtcgaaatggtccggctcacatgccccgacagtgcccaggcgctgaagatcgccgagagcttcggaaccgcgatcgtcgacagcgacggaatccgcgatctccatgagcgtctgatctccgagacggccgatgctctgagcgatggtctcggcgaaaaggccatgcagatccatctgcagcggatcgtcggcgccttcgtcggctcggcgcacggcgcaggccaattctatagccgcgccgtcaccgaggcacgcgatgccacggccaaggctgccaacgacgcccgcgacgaggacctcgacggccctgtcggctacgacagtgctgcccagcgcagacgcgagtttgccgccgacatgggcgtgcaggctcatgcgcttcgggtggccgcggagggcgccgttgcagcctacaagcaaatcgtcggtgaggcctggaaacccttcgatcggcccgtcgaaaacccaggtcactctcttgatcgcaaggcggccgaagcacagatgtcggccttcgactgagcgctttcgggcggggctccggccccgcctttttccatgtcgggaagcaagcgtgcctacggccttggaaaaggtcgcccgatgatctacattattttcgagatttatctacatggagacgacccatgccgatcaacgtcaacaatccggaagcggacgcgctgacgcgcaagttcgccgaaatggccggcgtcggcattaccgacgccatcgtcattgccatgcgggaggcgatcgagcgtcgcaatcgcgcggagacgccactgcagactgctgcgcggctgcgggaaaagcatggggtcgcgatgagcgacgacgtccgcaagcctcttcctcctgaagccttcgacgaaatgtgggatgacgcctgatgttcgtcgatgcctgcgccatcatcgcgcttctctctgatgagccggaagcggcgcgcgtctccgacgccgttgcttctgccagacatcccttcacatctccggtcgccattctcgaaacagtcctcggccttgcacggcccgacaagttcaatcttccagtgcccgcggtcgaaacgatcgtgatggaattcctcgaagcgcgggaaatcgagattcgcgatcttccgcccgcatccgagacgacgaggctcgcccttgtcgctgctcaccgctatcgcagcggccgccatggcctgaacctcggcgattgcctgcattatgcctgtgccaaattccatggcgtgccgatcctcgccactgcggatgagttcaggtcgaccgacctcgaaacaattccttgaatctcctgaagcagtgacgccgagatcggcccgtcgcgaacccgtccggcttttggtcctggcggagcgaggcgttcgggcaacggcttcgccgtcctccacgtccgttccggcctttcggtgccctcacccctttccgctccgcactttggaccgccgtgacggggtcgcgatcggcgcgacctccttgaattggaggtttgaaatgagcaggaaggacgaaggccagcgggccgacatctacacgcggatcactgacaagatcatcgaggatctggagaaaggagttcgcccatggatgaagccatggaacgccgcgaacacgaacggtcgtatcacccggccgcttcgccacaacggtcagccctattccggcatgaatgtgctgctgctttggtcggagggcctggcccgtggatattcctcgccgatgtggatgacattcaagcaggcgcttgaactgggatcggccgtgcggaagggcgagaccggctcgaccgtcgtgttcgcgagccgcttcacgaagtcggagaccgaccgcaacggcaacgatgtcgatcgggaaattccctttctgaaggcgtacttcgtcttcaacgttgaccagatcgacggtctgccggaccactattaccatcggccgacaccggtcctcgatccgattgagcggatcgagattgccgatcgcttcttccgcgacactggcgccgtcatccggcatggcggatcgcaggcatattattcgccggtgaccgaccacatccagatgccgccgttcgagaccttccgggatgtggagtcctactacgcgacccttggacatgaggaaattcattgggttggagccaaagatcgtcttgatcgcgatctgtcgcgctacgcgaaggaccggacggagcgcgcccgcgaggaattgattgccgaactcggcagctgctttctctgcgcggacctcgggattgctccagagctggagccgcgaccggatcacgcctcttaccttcagtcgtggctcaccgttctctcaaatgacaagtgggcgatctttcaggcggcagcgcatgcgcagcgtgcagtcagctatcttcacggtctgcagccgtccgcggaaggtgccgacaaggcggcggcataggcgtgctttgaatcagggacggtcgccagtaccgacggccgtctctctgattggctctggttcggtttgcggatgctggttcagggtgaggtccaacgtgccccagatcgatgacttcgtggcatcggacttgggtttgcgagacggcttcctctcgacgatgaacggttttgtctgctgacgcataaatcctcctgggcgacgaatcgcgcctgaacgatatcgcgcacgccaccgaacacaacaggctgtcattccaagtttcataccgacggtttcgacggcatgccgtcgccattcgcgacaaaaggattcccaccctcccccgcctgtccaggttgtttgtaaggaaaacacttcgccacatgggttgttgcggaatgctgcgtcgcacaaatataggatgcgaggatatcaactggaaggggcaggctgtggaaaaatacgtgggcgcgaagctgcatggcattcgagtgaccgacgcaaagctgaactaccacggctcgatcacgatcgatgcggacttctgccgggaggtcggtctgaaaccgctggaatatgtggaaatctggaacaagatgtccggagcaaggatcagcacttacgtgctctacggtgatccgggctccaggtgctgcattcttaacggtgcggccgctcgcacgtgccagcaaggcgatgagattatcatcgcgtccagcgtcttttgcgaaatcgatgacatcatcaagctcaagccacgcgtgctggtcttcggagaaaacaatgaaatcgtcgacaggatcacctacgaggtctttcgccgtgcagacaattctctcgacatggccgtgagctccgagctgcccgacaacagctacggatttccggcctccatttccggatagcctgatgcagtcggacggcgtccctggacgtttgccgatgtggattgccacgacaccgttttcgcctattgccgttgcccttcaggggagccattgtcccgtccctttacctgacgttagcggcgctccatttgcgggctcgatgaggcatgtctgaccggagagcggcgtcgcctcgatcgtcctcccgcaacggccattcgaaactttcttcccctgccgacttcgtcgccattcctcgcgcgacaacaaagttgctcccggccgccctccatttcatttcggccctctgggtgcggtccgatcgtccccggtccttgcgacagccatcgaggccgcaatggagcggcccgaaacagcaaaaggaacttggacaatggctaccatcggcaccttcacctccaccgaaaacggcttctccggctcgatccgcaccctcgccctcaacgtcaaggcccgcatcgcccgcgtcgaaaacccctccgacaaggggccgcacttccgcatctacgccggcaacgtcgagctcggcgccgcctggcagaagacctccgagcagggccgcgactatctctcggtcaagctcgacgacccgagcttccccgccccgatctacgcaacgctggccgaagtcgaaggcgaagatggcctgcagctgatctggtcacgccccaaccgcgactgaggttctcgaggctccgccgatccggcggagcctctcccgccaaagtgagaagccggcaccaggcatcgagccaggttccggctttttggtgccatgcggaaacggggatagccgctcagatttcctgatggtgccgggccgggccgacggcatcaaggacgagcggttaacccccaaatttcaggcccggtcctgcggcccgatccagaaattcggctcccccactcgccgcctccggcggtcgctatcgcgatccctgaccccgccatcccgtcccgccctgcgagctcgtctttcacgaactcaaggagatgagatcatgacgatcgaacagcacatcgaagaactgcgggccgagctgaacaacgcatgcgacgcggccgagcgccgccagatcgagggcgagcttgaacttgcacgggccgagctcgccgtgcaactggccgagcaggtcggcaccatcaaggccgagccgcccttctgaggcggcttctcttctcatttcagagccgagcttcgtcggcgatcaccgtctccgattccagcgctttccgcccgaggaacaaccgcgccatcgcatctctcctttcgacacagctgtcatctacgtcaggggatgttgcagtcctcgcgtcacgccgcaaccttgcgccaccagaattttccccaccgcatgcggctcctcgcccagtcaaaattcaggcggctccaggttctccgctcgcgcttcgaccgttccggtgcggccctcctccgaggtctgctttcgatccccgcgatatcagcaattcgaaaggagaacctaccatgcaacaactcgcaaagttccttgcagccaccggccgccggctcggtaatctcgggagagtgatctgtcacttcttccgcaagggaaagctcgggctgaagctcgcgatcaagattccgttcttcgtcgagatcgagctcaacttcgagaccgactggaataggcgcgaatgacgcgccatggccgccctcggcggcccttttccttcgttccggctcgggcgtcatcgttggtcagctgagaggacgctgggcaaaagtcctcggtcgatagccgcgagctcgcttctgccgcgtcaggtcgaggaacagtctgaccgcttcttcctcccgcccgaaatggtgcaccatcatttgtccagaggtcccgatccgcccccagcgtcgcgtcaggcaggtttccccgaaaagcgatatggaaatctgcatggcgtaaaagcgggccatgttcttcgccgtgtcggttcgctcgatgtagagctggtaaggttgcgtgaccatgttcgcagagtcgccgatccgtgcccgagcgtccaacgacagttttgaatcgttcgaggccaaccgattcattgcggtgatgtttctcaaaacctgagcgattgtctgggcgagtcggcgcagccgcacggctctagtcgctgtggctcccggagcccagtcggtctccgcgcattcgcgtgacgatcctctcgcggatggcacagggccaacctcgcgcgatcagttgcagtatcccgagcgctccggacatggccgtgcaagtcatccgagagtggatccgacgacttcattcaaactttaatttaattttcattctctctgaataattattattgcaatcaggttcaactaggcaaagcacctgcggatcaggcactgcagcgcaatgagagaaagtcagagacatggcagaaattatcgacttccccttggagcgcagcctcagcaccgaacaacgtgcactgatcgaccagatggaagaagaaggcggccgctttctcaaggcgacggagagcctgcttggcgtcctgcggcaagctgaacgtacgcagaaggcaattctcgcctaccaagccgagatcaaaggccggagcggaggaacggcgcaggtagccagtcgcgaagcgggcgacggttccgcagctggcgactatcgcggcagcactatccgatatgcatccgatgactgaagtttttcgagtgggtgacgatcgtcgccatcgtggccatacgtgaggggacagaccgtgcttgggttcgcaaaacaaaaacaatatgctctcctcttgggagcagcactcctccttggccacagcgcaagagcgcaagacatagacttgatgaacggggtggtagcccgccctggtgacaaggacacaatacccgcagaaaaattcaagaaggcgagcccctggaaaatcgggatgagccactttggcgtcaacgccaacacatgggctgcccaaatggccgctgaatcgcaagccgctgccaagagtgatccgcgcatttctcagttcgtgctgctcgacgccaatctcagccaggccaagcagatcgccgatatcgatgagctgatcgcccagaaggtcgatgccatcatcgtgacaccggtctctccgacctccgcagatgctggtatcgaaaaagcggtcaatgccggcattcccgtcatcgtccatacgggccttaccaaaaccgacaaattcaccgtcgatattcaaggcggcggcgagaacttcggaaaggtctcgggagagttcctggtcaaggaactcggaggcaagggcaatatctgggtcctgcgcggactgccgactcatcccgaagacatcaaccgctacaagggcctgctcgaagccatcaagggcaccgatatcaagatcgtggccgaagatgccggtctctggtcgtatgattacggccacaaggtttgcgagaccttctatctcgaaaacccgaaggtcgacggcatctggtcatcgggcgccgacatgagccgcgcctgcatggatgtcttccagcaatatggcgcgaaggttccgccgatcaccggtgaggtgaacaacggatttctccagaaatggatcgacagcggggttgatgccatcgccaccgaatacgggccggaacaaggggccgcagctgttcgcgctgccgtcgcgctgctcgatggcaaagccattcacaaacgctatgtctatgagcccgacggctgggacatccagaaggcaaaggcgaattaccgcgctgacctgtcggagaagttctggatgccaagcagcctgaccgacaccgatcttaaggccctgtacggcaagtaagacaaatgcctgccccgcgttaccgcggctcgatgaacgtcagaagtcgatgtcatcacgaaactattcgaaccaccccagcgagcgtggcgtgatcaaagcgcccactgtcgccccgaatccaaggagccgtcttcgatgacaccagcaacagcgaaatccaacgaccgacgtaatttcgggatcgccggacgcttgacggcggcatttgtcggcattgctgccctcgccgccatcgccggcgcctcctcgtcctggtattcgatgaaaagttccggcatcgtcaaggaactcggcgatcgaaccctcccaaccgtcaccgaatccctcgccttcgcgcaagaaagcgccatccttctcgcagaggcgcccaatctcgtctatgagccggatctcgcttcgctcgacgcaagttcgaagcgcctggaagccatcctcgccggtcaaagcggtcgactgacggctttgcgcgaccttggcgtggcgccggaactgctcgattcggtcgagaagacgagccaaagcctcgaaccaaagctcaatcagctgacagccatatcttccgaccggatcaaggcgaaattccgcatgcaggagggcgtggctcgcgctctgtcccgttacaagtccctggcgtcaatgctccgcaacgcgcaggtcggagcggtggacagcagtatcgagcgatcgcgtgccctgaccgatctccagatggcggccgccgagatatcgacactgatatcggcgataccggatgcgtcagacaccgaactggccgcagtcaaggatcaatatgatgcgactggcaaggagattgacagcatcctcgcgcggctgaaagcttcaggcggtagtgctgcgatgcaacagcttgtcacggctctccagaatgagggtggaggtcctgaaggcctgtttgcgcttcgatccgcccaggccaaggtcaacggtcagatcgcagatatgctgaatgatctgacggtgacctccatcatccttggcgtcgacgtcaaattgatcgcggcgaaggaaaagcaggccgcccgaaatgctgcggaattgtctcgggggatgacccagcagactgtcgccgtcaatgcggcaacgagctttctggtgattgcagccgcgcttgccgccctgttctacgtccggcgtttcgtgacgcggcggctgatcaggcttgcgacggtcatgggccgtatcgcctccggtgatcattccactcaggttcccatgtccggtcgcgacgagataacggacatggccggcgctgtcgaagtgttccgcgccaatgcggtcgccaatattcgcctcgagcaggaagcggaagaacagcgaaacctgacggaagacgatcgtcgccgtaaggctgaaagcgatcgcctccgggcagaagccatggcccaagccacccaaggtctcggcaaagggctcaagcacctttctgcgggtgatttgacgttccgtctctccgagcccttcgcggatgaattcgagacgctgcgcgccgatttcaatggcgcggccggccagcttgccgagacgctgcgctccgtcgccgacgcggccaacgccatcgatagcggcagccgcgaggttagcatcagcgccgatgatctctccaagcgcaccgagcagcaggccgcgtcgctggaagaaacggcggcggcgctcgaccagatcaccgtgaatgtcgccaattcttccaagcgggccgacgaagcccgcaggatcgccgcccaggccaataccagtgcctcccaatccggccaagtggtggcgagtgctgtcgacgccatggagaagatcgagcaatcgtcgaagcaggtctccaacatcatcggcgtcatcgacgaaatcgcgttccagaccaatctacttgcgctcaatgccggcgtcgaagcggcccgtgccggcgaggccggcaaaggcttcgcggttgttgcacaggaagtgcgtgaactcgcgcaacgctccgccaaggccgccagagagatcaaggagctgatccgcaactcctccgtcgaggtggagaatggcgtgaagctcgtcagcgagaccgggactgccctgaaaaccatcgagggctacatcgtcaccgtcaaccagcatatggactcgatcgcgacatcggcccgggaacaatcggtcggtctcgcggaggtgaataccgccgtcaaccagatggatcaggtcacgcagcagaatgcggccatggtcgaggagagcaatgcggcgagcgcgacccttgccggtgaagcaggacggcttcgcgacctgatcagccagttccagtttggcgaagccatgcgccggccggcgtccctcaccgaggcgagcccatccagccggccggtcgcatcgcccgcgcgccggatcgtcggcgccgtcgccaaggccttttccggcaacgccgccgtcaagcagacctgggaagagttctgagcggagctgaaggtgcactgactgaaggtcttttggccatcagagctggcaagcggtcgcgtccttttcaggacgcggtcctatctctctctgacgtcctatcttgcacccgccgttccggcgtcaatgacatcgcggcccctccaattttccccgcaccgcaagcggcacagagaaagtcggttcctccgctcgccgcacggcggccgcgttcagcggtccctgacccctcacggacttcggtgcggacacttttcgccagaaaacgaaaaggagaccctgatgacacagcatcacatcacacagccggttagcgaagagcggaaacttgcggatcagcagccgaccgggcttgaacatctgcgcagcagtttcgatgctgaagtgcaccttcccgccgatatctcgcgcgagtttctgtctgcggcgctgctttgggccatcgacaacaaggtcgatttcggtttgttccacgagcccggaaagatcatcatcgcgcacttcggtggtgatgagatctacctcccctcccggtggtccgacaaacgatggcacatcggccttgaggacaaggagcctttcgacccgggcgattgaagcccagaccagaggcggcttaccgcctctggtctttgcctttcgcttgagccgttcctgccggatcgaccagccgagccggctatgatcccaagccccatctctctctcctgacagcggacgatgatgatggttgtcatttcccctggcaccagccatgtcgcgcgccatcccatggccgggcaaggccttccttgatcaaaacatcgcccagagaattgcccgcacgcgatacggttcgaagtttacgtccatacttgtcctcgtcgcggaagccggccgacagcgaaaactttccggcgttgagcagcgttagtagtcgcgactttgccgcttcacctttgatccgttcagcttcgcagcggggcgggctgagttcgggcgtatcgatgtcggcgatgcggattttcttgccctcgaaccagaaggtgtcgccgtcgacgacgcagttcgtgcgatggctgtcgccgcagatcacgaacgacgccgattggctgtcttgcgcaggcgctttgacgaaagccgcagcgatgtcgagatggccattgcgatcaagatagagccagcccgcggcgccgatcaccacggcccagacaatcgcggtcggaaagcctcggccgcgatcgtgaccatgacgacgcggcgtcgatcgcgagtcattaatgccgggacggtcgttggcgaccttccgatttttcctgaacgggatgacgttcttttgcgccaagcttttcattcctcttcggcggcagaggttacagccggtttggtttcataggcgtttaccgcagacgccgaattcgaaccttccttctcccttccgcccatcgaatgaaaccggttctcgccgacgcaggctctcatatcgttgcgccggaaccagatggcgcgcccgcatctgagcggtgcattgccggccgtgaacacgatctgctcgtcggcccgcatgcgcagaacctcatgcggctggataagcggtctggcggcaagctgcttcgagcgtgttcgcgatgatccccttgcctgggaactgcggctgacctggtcgatctcgaccgtggtcatgccgcaacgtttcgagatgtagtcggcggtctcgggatcgttaattgcggcgaacgagatccagctggcactctcgaaccacttgcttgccgcgtcgcggccgccataggtttcgcgcatctggccgatcgactgatagatcatcgtcagcgtgattccgtatttgcggccggcgtcgcgcgcagtctcgaggatccgcatgtaaccgaggcgggcgacctcatcgagaagaaacagcgcgcgcccttcaagctttccgtcgcgattatagatcgcgttgagaagcgagccgatgacgacacgcgcaagaccggaatgagtctccaacgtcttgaggtcgatgttgatgaagacgtcggtatttcccgcggcgatgtcgctggtcgagaatttccgtccggacaccagggcggcataattcggataggaaagccaatgcgtttccttgaccgcattggcatagacgccggagaaggtttccggcgtcatattgacgaaggcagcgacgttctccttcacgaaatccgaacccgaattgtcgtagatgtcctgcaggcgcttgcgcaaggtcggttccggctccgacaggttcatgcgcacccggcgaagcgtctggtccttctcgtccatgtgaccggacaggcagacatcggcgatgagcgcggtgagcaactgcagggctgacgcgcgaaagaagtcgtcacggacaccgcgcgcgccgccgctgtcgctcatgatccacgatgcgacagaggcaatatcctcttccttcgttccgccgaaacggccgacccagtccagcacgttgaagcccatgtccgacttcctcgggtcgaggacgaacacgtcccttcccgctccgccgcgatgcgcggagaccatcggggcgacctcgttcgacggatcgagcacgatcagcgtgccgccccatttgagtgccgtcgggatggtcaccgacgtcgtcttgaaaccaccggaccccgcaaagacgatcccgtgcgacgagccgaatgagccatcgaagcacagcaacggcgacttgccgccggcgccccaggtctccgcgctatcggctcgaaatgccaatgccgcgacgctgtccttgtcgacccgatagcgctcgccgatgacgatgccgccggaatcggaaaacagcttcgccgcctctggcggcttcatccagtcggcttcgccatgcagtgccctcttgccctgaatgcgctttggctcggcccttgcgaatgccgcattgccgatgaacgcaacgcggagtgcgaagcaggcacacatgaacgctgcgcctactccaatcgacgttgccggatcgagataggcgaagaccgtcttgccggttggcagcgtcttcgtgaaagcggcaaggcgtatggtttcgcgggtagccgcgatcaggatcgttccactgcatcccgcaacgacgccccagcctgcctgcttgatgctgatcgcgccggcacttgcgaacaagaacacgataccgatcgccgcgctggcgacatagggcagcgcgatgcccgcacgcccccatgccaagcgtgcggcctcggtcttcccgaagccggaaatccactgctcgatccccgtcatcccgatgacgaccaggatcatcagcgccgccggcccgacgacgagcgcaatcctattgatcgtcattgccaaaggcctccgcgccgattgccgtgagcctggatcgctcgccctcatcacccttgattcggcgggcgacatcgatcagcgcgcccagcaacagcgcgcgcttctcgtaacgcagcccggccttgacgatcaggccgccgagctcgatcttttcccgcgtttccttcttgcgggcgtcggatgtcatcgtcctcgccatacgctcaagcctcgccagtgctgcccgcgcccgcaccagaggagtccgccggcgtcgacgttgcgccgctgctatcgccggcaccctttttccctccgttcgtagcgcccttccctcccccttggcctccgcgaaaccgcgtcgccacttcctcgaaagcggcctgcagctccccttcctcaatctcgatctcgccaaggccggccttgagcgcgatccggccgatccgctcggcttctcttgtctcggcgaccttgagctgctcctgcaacttggcgatttcgtcgcggattttcgaggcaggttttttcatgtccgatcgtctccatggctgagaaagcttgtctttcgaagccagtctttccgaacggagtgcggaacgcactactgtgaatcctacaatcgccaagggcgattctttggtgaatgatcccggccgttccgaaggagcggcttccaagggcgcaattatacgtcgctcacgcgacgcccttgcttggtccggcctcccgctcccgacgaacccgttgatttcgtttgcaaccgggaaagaactccgccgtggccgtcccccatttctccgtcagcgtcgtcgcccgcggctccggccgcagcgctgtcctgtcggcggcctaccggcactgcgcgaaaatggaatacgagcgggaagcgcgaacgatcgattacacccgcaagctggggctgttgcacgaagagtttgtgattccggcagactcgcccgaatgggtgcgcagcatgattgcagatcgctcagtcgcgggagcatccgaagccttctggaacaaggtggaggcattcgagaagcgatccgatgcgcagctcgccaaggatgtcaccattgccctgccgctcgagctgacatccgagcagaatatcgctctcatgcgcgactttgtggagaggcacatcacggcgaaggggatggtcgccgactgggtctatcacgacgcccccggcaatccgcatgtccacctgatgacgacattgcggccgctcaccgaagatgggttcggttcgaagaaggtcgctgtgctcggtcgggacggcaaaccgatccgcaatgatgcaggcaagatcgtctatgacctgtgggccggtagcactgaggacttcaacgctttccgcgacggctggtttgcctgccagaacaaacatctggcgctcgccggcctcgatattcgcatcgatggccgctccttcgaaaagcagggtatcgacctcgagccgaccattcacctcggcgtcggcgccaaagccatcgagcgcaaggccgagcaatccgacgggaagcaggagaccgcgcctcccaaactcgaacgcatcgagcttcaggaagctcgtcgtagcgagaatgcacgccgcatccagcgccgccccgagatcgtgcttgagctgatcacgcgggagaagagcgtcttcgacgaacgtgatgttgcgaaggtgttgtatcgctatatcgacgatgcccgtctcttccaaagcctgatggtgaggattctgcagagcccggaagcgctcaggctcgagcgcgagcgaatgaatcttgcgaccggggtccgagagctggcgaaatacacgacccgggagatgatccggcttgaagccgagatggccaaccgcgctatctggctttccgctcgcgcctcccatggtgtccgtgaggcggtgctgcaggcgacctttgcacgccattctcgtctatcggatgagcagcggacggcgatcgaacatgtcgccggcggagagaggatcgccgccgtgattggtcgtgccggcgccggcaagacgacgatgatgaaggctgcccgtgaggcgtgggaagcagccggctatcgtgtggtcggcatagcactggccggcaaagcagccgagggattggagaaggaagcgggcatcccatcgcgcacgctgtcgtcgtgggagcttcgctggaaccagggtcgcaaccagctcgacaacaagactgtcatcgtactcgacgaggccggcatggtgtcgtcacggcagatggcgctgttggtcgagacggtgaccaaggccggcgccaaacttgtcctcgtcggcgatcccgaacaactccagccgatcgaagcgggtgccgcctttcgcgccattgccgctcgcatcggctatgccgaactcgaaacgatctaccgtcagcgccagcaatggatgcgcgatgcctcgctcgatctcgctcgtggcaatatccgcaaggctgtcgacgcctataccgctcatggtcgaatgattggcttgagactgaaggacgaggcggtcgagagcctgatcgcagcgtgggaccgcgactacgacccctcgaagaccagcctgatcctcgcgcaccttcgccgtgatgtgcgaatgctcaacgatatggcgcgcgccaagttggtcgaacgcggtgtcgtcgcagaaggatttgcattcaagacggaggacggacaccgcaaatttgcgccgggagatcagatcgtgttcctcaagaacgagggcagcctcggcgttaagaacggcatgctcgcaaaggtgctcaaagccgctcctggccgggtcgtcgccgaggttggtgaaggagagcaccgccgtcaggttactatcgagcagcgcttctacaacaatctcgatcacggttatgccacgacgatccacaagagccagggggcgaccgtcgaccgggtgaaggtgcttgcgtcactgtcgctcgaccggcatctgacctacgtcgcgatgacccgccatcgtgaagatctcgccgtctactacggcagtcgctccttcgcgaaatccggcggcctcatcccgatcctatcgcgccgaaacgccaaggagacgaccctcgattacgagcaggcgtcgttctatcgccaggcgctgcgcttcgcggaagcccggggcctgcacctcatgaatgtcgcccgggcggtcgcgcgcgatcgcctggaatggaccattcggcagaaacagaagctggtcggcctcggcgcccgtcttgccgcaattgcaacgaaactcggtttcgtcggcaacttcaaaaactccccaatccagaacccgatcaaggaggccaagcccatggtgtcaggcatcaccaccttccctaaatcgttcgagcaggctgtcgaggacaagctcgccgccgaccccggcctcaagaaacaatgggaggacgtctcgacccgcttccacctcgtctacgcgcagccggaggctgccttcaaggcaatcaatgtcgacgcgatggtcaaggaccaatcggtcgcgaagtccactctcgcgaaggtcgccgacgcccccgaaagtttcggtacgctaaagggcaagcccggtcttcttgccagccgtgccgagaagcaggaccgggaaaaagccatcgccaatgtcccggcacttggccgcaatcttgaacgctatcttcgtgagcgggccgaggccgaattgaagcatgagacggaggagcgcgcggtccggctcaaggtttcggtcgacatccctgcgctctcgccagcggccaagcagatgctcgaacgcgtccgcgatgccatcgatcgcaacgatctccctgccggccttgaatatgcgttggccgacaaaatggtgaaagctgaactcgaaggtttcgcgaaggctgtgtccgagcgtttcggagaacggaccttcctgcctctcgccgcgaaagacaccaacggcaaggccttcgagaccgttacagcgggcatgacggctggccagaaggctgaggtccagtctgcgtggaattccatgcggacggtccagcagcttgccgctcatgaacgaacgacggaggcgcttaagcaggctgagacactgcgccagacgaagagccaagggctctccctgaaatgacggcggcagctagagcgcgccaggcgataaccgcgcaacaacgacgagcggccgtgatcctctcggccacgacgttggccgctatcgtgctggtggcgactgccctcgccggcggttatcgcatcaatctgaccccgagcgagccactcggcctgtggcgtatcgttccgctcggtcgccccgttgctgtcagtgacctagtgttcgtttgcccaccggcaaccgcggaaatgcgggaggcgcgagcgcgcgactatctccgttccggttcctgcccgggtggcgtcgccccgttgatcaagacggtgatcgccgtcgcaggccagcatgtcgaaatcggcgccagcgtgattgtcgatgggcgggtggttgcctcttccagcctcgcgccacgagacggaaaggggcggccgctggcgccgtttccgagtggcatcgttccgccaggacatctcttcctgcattcggcgttcccgggctccttcgactcccggtacttcggtccggtgcccgcttcaggcattctcggcctagcgcaggagatcctcacctatgcgccgtgagtttcttcgggcgacgcagctgatagtcgcttcgatcgcgatcggcgtggtgggctggagcggccacgcgttgcttctgcccgtcgccctggcgtttcccgttctttggtcgatggcgcaaacgagggcggtcgcggcccttgtctcggccagctattttctggccgcatctcgtggcctgccgcaaggcgtcgctgccttctattcgtctgatatctggccggggctgctcctctggctgtgcgcgtcctcgagcttcgtcgccgtgcatacggtcctgtggaccgggatcgccggcattcgtccgttccgctatctccttgcggccgtcatcatggccgtcccgccgttcggcatcacgggctgggcgcatcctgtcacggccgctggagttttgtttccgggatggggatggtggggactgggctggatgacagctggccttgcgggcctcgtaacccgcatatggccagctgtcgccatcgccttgaccggcttttggctatggtccgccgcaatctggaccgacccgagactaccggaagcctggcgcggcgtcgatctggaaatgggcgcttcgcttggccgcgacaccggtcttcgacgccagcatgacctgatcgcaacggtgcgcgacgctgccggcgatggcacccgctttgtggtgttgccagaaagtgcgctcggcttctggacgccgaccgtggagcgtctatggacgggcgcacttgccgatggcgatgccaccgtcatcgccggcgccgtggtagtcgacgcagacggctacgacaatgtcctcgtctcgatcgacggcaagggtcgccgcatcctttatcgcgaacgcatgccggttcccggctcgatgtggcagccatggcgatcctggtttggggagagcggcggcgcccgggcggatttcttcgcgaacccaatcgtcactatcggtgccggccgggccgcaccactgatctgctacgagcaactgatcgtttggccggtcctgcagtcgatgctgcacgatccggacgccatcctcgccgtcggaaacggctggtggaccgaaggcacgtcgatcattgccatacagcgcgccgcgactaccgcctgggtaaaactcttcgcaaagccgctcgtcattgcctttaacacctgaaaggagacactatgctggacgccgccctgatcaaagaatgcgccgacccttccctaaaacccgcgatcgtcgaacggttcgtggtatcagcaggctcggctgatcccctcgccgtcaccgtcaaatccggtggccgtttgatcctcgtgccaaaagctgcgtcggctgacgaggcgatggtgatcgtgcggcaatatgctggtcaggcggtggtccgcgtcggtctcacgcagtttcccgccggcgttggcgtcaaggaagcgagtgatctcaaaccggacctcgtcgatgcctgccagaacctccgcaaaggcacggcgatgttcgccaaggtgctccggatcgtcgcgaaatggtatggcaacccgacgagcaaagatgtcttcccgcagatcttcgaggatgcggtctacgcatggaagaccggcgagttcgagggcgtcagtgtgtttcaggcggaggatccgggaacggcagttgaagtgccgcagcaaagcgaggagaagatccccgacgaggaagagagcgccgaaccgaaaccaggagagcaagagcctgagacggtgcaggatgttggccgagcggggatgcggatcgacctctcacacattggaggccaaaaatagattgacttcgtttcgccgggggcagcgaggcgagtattgaggttcaaagcagaaaattagtgtaactcaaatgcatgatattagtgtttgtcggaacgccccgcacgaacgtggtgttcgagttgatcaaagcaccagcacagccatccacgaaagaacggccgcgcggaaatacgattagagcagattcatgcccggctgcgtcataacggggcctcaagggcagcaactagcagtcagcacgcgcgcgtctactcatctcgtcacaagcacggcaggttcgacgcccagtgcctctgcgatttggccaaggacggtgacggtcgccgacatctcggcacgctcgattgctccgacatggcggacactgaggcccgtacggtgggccacttcctcctgcgtcaattgtttgccatgacggattcgacgcatattgatcgccatgacctccttgagatccatgacgcgagcggaacctgaatcggaactattattccaggaactatagttccgattcgtcacggcgcgtgatattgctcgtccaggccgtcacaagttaccttgggatatagggtatatgaacttctgaaagacaggccgtgcagttatggcctatgcggtataatgctcaccaggatttggctttcgagcggcaaatgaagaaattaaggggaagcggatgaaggacgtgaacttatccgagacaaaacacgaaaccaaaccgatgggatcctgtttacgttcaatggaaaaatcagaactagaggcgcttgctatatctgcaatccgagagcaccgccggcttatagtcgccgacgaagctgtttatgaggaatggacccgcgcgtccgccgacccctcggtttcgagcgccgtgctcgaaagcttgcagcaagagtatgccgcgcggcaaaggaaatccgaagcccagcaggaagagctttcggagatcatcgatgtgctcggctacatccccgaggttccgctcgatggcgatgaatgacccctcaaaccaagccgtgatctttagcgatcgcgactagatgtggaacggtcgccgcgtcaagtttctcgcgcgctttatcgaggtagtgctgcaccgtcctcgcgttgatccccgtcaacattgcggtttccggggcacttttgccctttgctgcccacatgaggcacatcgcttcccttggcgagagtagccgcttcggagcgattatcgtcgtcgaagcgataatcttcaggcggtaatggattgcaaggaccgtccggacggctttctgggcgtccagcagtttggctttctcgactttcttctccgacgaggcaaaggtcagcatcatcgtcgacccgaaactcccttcgaccggaatcgtcagcccactgcgaatgccgtgctcgatcgcctggtcgcgaaaccgtctcagctccgaggtgccacgagccggccaatcatcggccgtccagtagaacatctccatgcgacgcttggcttccgtgatgacggggtcgatgcgcgaatattggccgccaagatagatatcctgccatccctccggataggagttgaatgtgcggatttccaggccctcggtctgaagatacgcaaaacgttcgaagccatgggagtttacgaagcttttcagggcgcccttgatcatgcgttcatcgtgcgcagcttccgtcatatcgattaaagagcgaaggtctccgtccacggacttgtctcctcttgcgcagctgcgagcctcccacccgtcgcgcctaccacgcgccgcgagttacctggtgccaccgttcggccagccggagccatacggaacatcggaccgtggctgcgaattccgtgtccccattcgtttccgatgaaaacgcagttgccttctgccgaagcatatccacggccgttgcaactggttttctactcacctctaccgagtattcaaggcctcttcatctaaaatatgacaatttgagagaagattttggcgagcgctgatttctgagcgcggatggatcgctccacccgacgaaacgacgggcggagcagcgttcgagatgggttagcgcccgctataaatggatggaaagatgatatcctggtccgcgagaacgttgaacttatagccaggacggatgcgaatcgtcggctgaacgttgaggttcttcgagattgtctgttctgtgacgcgaccgaagctttcggcaaaattccgccgtgctgcatccgatgccgtgtcctgggtggccaatgttgaactctccggcatcgacatgtcgatccccgtcccgatgattgccaccagagctgcggaaccgaacgtcctccagagatggcggtcaaccttgtcctggaagccgccatacccctcggcgtccgtgccggccatgccgccgatctgcagggtggatccattgggaaaaataaggtcagtccagacgacgagaacacgctcctggccgaatgagaccttggaatcatagcgaccgaacagctttgcgccctgcgggataaggaggcgatagccgctcgcgctgtcgtagacattctggctgacctgcgcggtaatccgccctggcaggtcggaattgaggccggtgatcaaggtggcgggaatgaccgagccgcgcttcagttcgtagggtgacatctgcggcacgacctggtttggcaggtagccgagatccttgatgtcctgattgaaaaaatcctccttcgacggctgtccgttctgatcgacgttttggcccatcaggccggatttcatggcggcggcataaaggtccgacgcactgttgacggctgcatttgtcggctggcggccgctgtcattggtggaggttgccttctcgaagtctccgatgtctaccttcagcggcgaatcgagcgccgtagcgcgagcctggaggcgagccatccgctggcgctgcgcttcccggatatactgctcgtcctgctcccgcttcaggcgagccttccactcctcctcggattcgagcgagcgtctctcctgtcggtcattcggccggcgttcaacggcggtctcctgtttctcgaccttctgctcgacgacaggggtcggttgaaacacttcctgcttctccggctcgccgatgatgccgtcggtgacaccccgtttgagctggtcgccgaagctggtcgccggggtgttggaagccccctcgatgtcgcctcgatggaaggacagcccccgcagcgacaggccgatcacgacgacgccaacgaagagcgcgacgacgatgatggcgatgatgatcggcaggcggttgagccggcgcatgccattctgatcgtcggactgggctggcgcgccaagttggagcgactggaccatattgctctccgtcagttgcgctgcatgatcgaaagtggactggtcggcgtggcgccggccgccgtcggcgtataggcgcggccaagagcgatggaaggcgtcgaaacgcgcgcaaaaacctgcccgtcgaagccctcgacggcaaaagcaagctcgaccggcttgatgtctttggcgaccttgccgtccgtgacgaccgtataaccccagcccttcagggccgcctcgagggcggtcgcgaattccgactggtccttttccattttgatggtcgtcgcagcgctggccggaccgatttgttcggcgagacgacttgccatgtcaccggcgatcgcgcttgcggccggtccggtgacggcaaccggggttgcattggtggtcatcgcgtcgtcggccgtttggcaaccggagagtagtttggccgcgatgaagagtgcgaggagcttgcgcatggttcagcctccccgccggatggtgatcttctgctgccgccacccgacccctgatacgaggatcgccttgtcgatcgcatagtcgacggtcatcatgttgttcttcatccggtagttgacgatgcggttctgaccgccggagacgacgaagagcaccggcgcatcctgacctgagatcgacttcgggaattggatgtaggtcttgaccccgtccgaatagacccgcttcggtttccacgaagccccgccgctgatcgaataggagaagttcagcttatccggcgccgtgcccggaatgccgccggtttcgagacgggcattgatgtcggcgagcttggtggaggtgtcctcggggtactcgaaaccaacgcgcgccatgtactggctgggatgggacttgagctggatatgataggttcgccgtgaggtggtgacgaccatcgaggtgagaagacctggctccgacggtttgacaatcagatggatggcctgcccgcctgtcgcccccgaggtggccggctccactttccaccgcaccgtatcgccgacgagcacgtcgcgaacgatctcaccgccctgaagctcgatgtcgcagacctgcagcggcgagcagacgacggacggctgggtctcgccgaacagaaaaatcactttgccgtccggtcccgttgtgaccaggcccggtgtgccgcgccatttgcgggagatattcgtacccttgacctcgttgctcgtcatgctttgcgcctgcgcgcccaccacaaaggcgagtccggccatgcagccggcggctgcgatcaatcctgtcttttgcattgagaaatccctgcccttaaagctgtgccgtccagtcgaaatcccggacatagaggccgatcggattgaggcggatcgtcgcctcatcctgtggcgcggtgagcgccaccgttgcgatgccgcggaagcggcgtgtgccggtttccttgcccttgcggtctcgctcgtattccgtccagtcgatctgataggtctggttcgagagcgccacgatgttgttgacctcgatggcgacggtcgaggacttcgctttctcgaaaggtgaattgcctcggaaccaggcgttgaccttctccgtcgacggatcggaggtgcgaagaagagcgtatgtgcggtcgatatattgcttctgcaccacggcatccggcgtgatcgagcgaaagcttgtcacgaagttgccgagtgtggcgcgaaccacgcggacatcggcatattcgatctgctccgggaagcctgccgtgactgccgtccccagcttgtcgacctcaacgatataaggcacgagcttgacctgggtactgagatacatcgcgtagctgaagccgatgacggccatcgtcaggccgagaatgccgacgatccgccatgcggaagcagccttcacatatgtgccgtagcgctcgttccattcctggcgggcggcaagatacggattatcaggggcgcggttcgctgccatttattcttcccttgtctcgattatggtttgtcgttgcgttcgggaggaggcgtcgggccgctgtgaccgctgcgctgttcatcgagcttggcgttggctagtccgaggatggaccccgcataagcaccgggagatccgattgccttttccttcgcggccgagcctgcggcttgtgccccggaactgaagcttgcgcctatcccccgcagggcagcaccagcgacggatgaaccgccagctcgtgcggcttgggccgccgcaaaacccgcgccggcagcgccggcggccaagaatccagcgcccgcggcgaaggacgccgcttgcccgccgtggcggattgtctccataccgccggtgacggaggctccctggacgacaccctggatgatgttcggcacgtacatggcgatgatgaagaccacgacggaaataccggcgatcgccagggtggtgacaaactggtcggaggatgcggtcggggcattggccagacccaagaggacctgtgacccaatctttgcgatcatcaccagcgccatcagtttcatgccaacgccgaaggcgtagacaagatagcgaacagcaaagtctttggtgaaggaggaaccgcccaggccaagcatgatcatgccggcgagcaggccgacatacatctcaaccatcaccgaaacaaaaatcgcggcaaccagcgaaaagcagatgacgacgacacccattgccagcaccgcggcaatcgccagcgcattgtcctcgaatacgccgaactgcgcctgttgcgacatttgcgaggcgacgcgaatgccggcatcgaacacttcagcgggcgaggctgaaccgccgccggcaccaatttggaaaagactgtcaaccaccgcccgggcaaaggtcggaccttgggtcagaacgaatgcgaagaacccgacgaacatgatccggcgcaccagctccgcaaaccagctatccagcgaggctgactggatcgccagccagacggcggcaatgccgatctcgatcgttgcgaggatccagaacagcgatttcgccgcatccatgatggtggtctcccagcccttcgcggcagaggagacctggttttccagttccgtgaggacctgcccctcctgcgcaaatgcgggagcagcataggcgaggaagaacagaccagttatcaggagtgaacgtgtgacagcgggcttcaccatctcggccgtatctcctgaccatccttgatcggcggcagctccttattcgagccgaagaacttctcccgggctgagcgctgctcctcggtaagcgcaggtcttccgccgtcgctggattttacgatcagcactgtggccgcggcggatgcagcggcgacagcaagcaccaaagcaattaggacggatcggctcaccagcgtggctccattctctgaccttccggaatgctcttgacctcagcgttgaagaacttttcccgccgggcctgcgccaggtccttgtcggtctgctccgtctgtagccaggttcccatcatcgtcatctgttgcgagacgagaccgcgaagcttctgcatctgggcaacctgctgagcggcgatctcgtggccgacctgcaacgctttcatctgcccgtccgccgtttcggacatcgaccgcagcgaggacatcgtatcttcctcgctatcgaactggtcggccgttaggctcgcagccttcagcgagctggcgatcgtgtcgcggttggtcgtcgaccaggactgataagtcgaggagaacgtcgcgttatccggcaggttggttttgaggtcggcgtagctctgaaagcgctgctgaagaacgtcgtcggcgttgcccatggagaatgagatactctgaccctggtcgacaatactgcggagctgattgagatcgctttcgacctgcccccagacatggtcaggcagctgcgcggtgttttgcagcatgttttggtagatcttaagctggttctggatctgctccgcaagctggctgatctgcgtcagctgattgtcgacctggaggcccgagctcttgagaaggtccaccaattgcgcattgttggcgagctgcgtccactccgtcgcagcaccggtggcggtccccgcccgtgctgaaggtacggctccgatcgtcagggccgcggccgccaggcaggctaaccatctattcgaacttgagtagcgatgcggcatcgtgaactcctctcgtttcaagccagcggattggccactcgcggccatgtccggatttcagtgcgcggatgcgcttgaggtcgtccttgcccgacgcgccgacaaagctcagcgcaaccggccccagcgacatgtcgaagagccgccggccttccggcgtggcgacgtagtattcgcgtttggggactgcgttcgagacgatctcaatctggcgctcgttgaaaccgatacgctcgtaaaattcacgtgttcctggctctctggcggcgccattcggaaggcaaatcttggttgggcaagactccttcagcacatcgataatcccggaccgttcggcatccgagatcgattgggtcgcaaggacaacggcgcagttcgccttgcgcaagaccttgagccattccctgatcttgctgcggaaaactgggtggccaagcatcagccacgcctcatcgagcacgatcaggctcggcgatccatccagacgcttctcaatccgccggaacaagtaggtcagcaccggcacgagattgcgctcgcccatgttcatcagctgctcgatttcgaaggtctggaaggccccgagtgtcaggccgtcctcctccgcatcgaggagctggcccatcggcccgtcaacggtgtagtgatgcagcgcatccttgatctcgcgcagctgcacgccgctgacgaaatccgagagtgagcgaccggatgcgctcgccatcagtccgacctgccgagaaatggcgttacgatgatcgggggtgattgtgacgccctgcagaccgaccagcatctcgatccactcggtcgcccaggcccggttggcatcactttcgagatcagaaagcgggcagaaggccaaggccctcccctcttccgcattgtcgccgccgatctcatagtgatcaccaccggcagcgagcgtcaggggaagaagtgaactgcctttgtcaaaggcgaagatctgcgcattttcgtaccggcgaaactgtgcggcgatcagagcaagcagcgtcgacttaccagaacctgtcggaccgaagatcaacgtgtggccgacatcatcgacatgcaggttcagacggaacgctgtcgagccggtcgcaacctgcatcaagggaggggaattcggtgggtaaaaggggcatggcgcgatcgggtttccggcccagaccgaattcagcggaatcaagtcggcgagattgctggtgttgatcagtggctcacggatgttgcagtaccagttgcccggcaggctgccgagataggcatcggtggcgttcagcgtttcgatccgcgccccaaacccttccgcctggatcagccgccggatcgcttcggccttctcctgcagggcttcgcgatcgttgtcgaatagcacgacgaccggtgtgtaatatccataggcaaccagctgcgatgaggcctgcgcgatggcgtcctcggtctcggcgaccatggtcatcgcgtcttggtcgacggatcgactttgtgtctgaaatatctggtcgaagaacggccggaccttctgctgccatttcctgcgtgtgcgttcgagcttctgtcgggcctcctcggcatcaaggaagatgaaacgtgatgaccaccgataggtgagcggcatcaggtcaagactattcagaatgcccggccagctttcagccggcagaccgtcgatcgcgacgacgccgagaaagcgattttcgaccttcggcgtcagtccgtgttcaagctccgccgtggcgatccagtcgagatacatcggaacatcgggaagcctgattggatggttctcgccggtaatgcagaagcgggcgaactgaagcagttcgtcatatcgggcaattcgctcccctccccttccgaccgtttctcgggtttccattcgccggatcgaaagtgtgttggcaaaatactgctcaagctctcgcaccgcgttcttgaacacgaagagcaccgtgtccgcgtaggatttcttccggctctcctcgtccgaatagatgtacttgctgagagctgttttcttggactcgagcggccggtaagtcaggatcagcgcatgcttgctctcgaaatgcccctgctcgcgcgcgaaatgcgcccggcgctccccgtcgattgcgcgggttaccggatcggggaaatggcaacggtcttctgtgggatagtcgaccgtcggaatgcgaatggcgtcgacctggatcatccagccgcttccaagccgcgacagaacggcgttgatctgcctcgacaggtcgttgcgttcgaggtcagtcgcactttcggaatctggtcccgcgaaataccagccggccatcaggcttccgtccttcaagaggaggacaccattgtcgaccaggccggcatagggaacgagatcagcaaaggaagggccggtcgcccggaagcgtttgagagctaccatggccgcctcctcaataccggcgccaaggcgatgtcgtcgccttgtaggtgggcttgtaggaaatgtgcctgatatagacttgccgcatgaacgggtcggacttcgccatcattctgaggagcccgacgatcacgacccagacggcgattccgaagagcgccgaataaaccgtcagcaccacgaagatcaggatgacggcggcgagaccggtcagcaacacaagctccctgtcggcgcccatcagcaggtttggacgcgacagtgcacggtggatgcggttgcgctgcaggccggatggggaattagccatgagttccctccccgcctccggccgatccaatcgtggtgagctgttcgctcgtcagtcctatcgaggcgccggttgcgccaaacaggccgacgatgttggtggcgccgaggaggatgccggcgacgagaacgacgtatacaagtcgccgcgcgaaatcattcagttcgccgccgaagatgagcatgccgccggcgatggcgactgctgcaagcgcgatcgcacccgcgaccgggccggtgatcgactcctggatctgctgcagcggcccttcccacgggagactgccgccggagctggcaagggtcggcgcgaccgaggcgagaacgatgggcgccgccaagagcgcgacggcgatgaatgatttcctatgcgacatggcgcgcttcctgttcttctgtgagctgatcggattcgacctcgtattgaccgttgacgaaccgctcgacctggatgacgtcgcgaacgcgccgtccgcgcggcgtccgctcaatggagatcacgagatcgacggcttccccgatcacctcttgcatcggctgctggcttgcctcggccgtcagctgttcaagacggcgcagcgccgacatggcggtgttcgagtggatggtcgccacgccgcccggatgaccggtgttccaagccttgagcagggtcagggcagcgccgtcgcggacctcgcccacaactatccgatcaggacgcaggcgcatcgtgctctttagaagccgtgccatgtcgatcgtatcgctggtatggagcagaactgcgttctcggcagtgcattgaatttcggcggtgtcttccagaatgacgagccgatcttctggcgcgcttttcacgatctcgtcgatcacagcattcgcaagcgtcgtcttgcccgagcccgttccccggaaatgatgatgttgagcctcgcggaaatcgcgctgcggatcgtcgcggcctggtattcggtcatcactccggtccggacgtaatcttcgagcgggatgaggcgcgatgccctgcgccggatcgtgaaagcaggcctggcgaccacgggaggcaacagtccctcgaagcggtgaccgccgatcggcagctctccggagatgatcggctgttcggtatcgacctccgactgcagtgcatgcgcgacagtaccgatcaccatttcggccgcggccggggacatttcgccggcgggcgcaacgccatgtccgaggcgttcgataaacagctttccatccggattgagcatgatctcgacgactgttgcatcgtccagcgccacgcagagctggtcaccgagtgcttcctgaagtttacgcacaagccgagggtgagagcgaagctggttcacggatttctcctacgctgccttgctgagggaggtgaattcagagcgatagttggcgggacggagcttttgaaatgtactggcgtcggcgagtaggattcccgcgaccgccatcgtcaccccgaacttcctgggctcgcccaagcgctgaaggggccacccgacgcgcgcgaggatccgctcgaaacgcaggtcagtgacggtgacgatttcggtgaaaccgttcgacatgcaccattcgatgatgccggcgaacatggtcagcgtcgcctcatggacggatccgtctcccctgccctcgccgagcgccgtatcgacgcaaaaacgggagctctcgatcatcgcggaatgggcgttcaaccggccattcggaaggagtgagtgaaagacgtcggccaccattgtggggccaggcgccggaagcagccgcgcgcatcctgctacctggcgactgtcggaaattgcgaggatgtaagtcggtatcagagtgtcgaaagcatccaattccacgccgtcgataacttcgacatcccagcctagccggtcggcgaagacccgcgcgcgtagctcgtgatggcggtggataagctcagcttcctgaatatttttcggtgttgagatcgcgagaacctgcatgaatttctccgtcgtcgttgttcggcggagaactcagcacggtttggacacggtgagtagttgtaggattctacaaggtaagatccagctgagtcgcggtggtgagtctgctttagctggacgacaatgcggattccgtgtcgtctcctttgggttacgattgtaggattcacagtaagacaaatcatgaacatagctgacggtctggtatgctaacaggttgtattagataataaatccggattttgtgtgttaggtggatctgcggtcgttaaccttctgttaacgctatttcccttgcggcattgccagaatcatgcgttatcttgagacggcaataacgcgtctgacgctaataaaccgtctgaaacctgaggcccaagtgaacgtgatcgaccggcacattaatcgagcatcaacttccgcacacatcacccagcgcgcggaagcgttgtctgcgagactcagggcggttggtgagcgcgcgtttccccctaccgcacaaaagtcgcttcgatctttcacttccggcgaggtcgccgaaattgtcggcgtgtcagacggctatcttcgccagctttcgctcgatggactcggcccttcgccagatttgggaagcgccggtcgccgctcttacactttggagcaaatcaatcaactccgtgagtatcttgccggagctcgacctaaggaagcaagtagattttggccacgtcggcgcagtggcgaaaaacttcaggtgatcacggtcgcaaatttcaaaggcggctccgcgaagacaacaactgctgtttatctcgcacaaggacttgcgttgcagggctaccgtgtcttggcggttgatcttgatcctcaggcttccctctccgcaatgttcggttatcagccagagttcgacgttgccgaaaacacgaccctttatggtgcgatccgctacgacgaccagagggtgacgatgaaggacgttatccggcgcacctactttaccgggataagcattgtcccgggtaatctcgaactgatggagtttgaacatcagacccctcgattcatgctgcagaatcgagggcgtccggaggatctatttttcagacgtgtcgcaggcgcaatcaatcaggtcgaacaggacttcgacgtcgttgtcgtcgattgccccccacaactgggctttttgaccatgggcgcccttaacgcagcgagtggcatgattgtgactgtccatccccaaatggtcgatgtcgcatccatgagccagttcctcttgatgacgtccgatctcgtgtcggtaattgaagaagccggcggacggctcgactacgactttctacggtttcttattacgaggcatgatccgcgcgacgtccccgagcaggaaatcgtggcgctgcttcgtgacgtcttcggaatcgacgtcatggcggcatccgcatggaagtcgacggcaatcgccaatgccggtcttaccaagcagtcgctctatgaactctcgcgcggcgcggtaggacggacgacgtatgatcgagcaatggaatccatcaatgccgtgaatctggaaattatcgaccagataaacaaggtctggggtcgatgatggcggctcaatcgctgataaatcaaaaccttagtgtgttgtcagctgactacacggtcttactagaactgttgtttggatagggtcggaacgatgagcaaacgtacacaatccattcgctcaatgtttgccgggggcaacgatcagaccgcttctaatgacgcacagcagcctgtgcagcgagttgcctcgggtgcggtccggtcgttgaaagacacgttctcagaggtggaaagacattacgaagagctcaagcagcaagttgctgacggagctgttccagtcgaaatagacccagaattggtcgacccctcgcccttcgcggaccggtttgaggaccaagacatggctgtcttggaggtccttaagacttcgatcaaagatcatggacaagaaattccgatccttgttcgaccgcatccagctgagatcggacgatatcaggttgcctacggccaccgcagactacgtgcgactgccgaactcggcttgaaagtcaaagcctatgtccgcgaactggatgacgatcgtcttgtcgtcgcgcagggcattgagaattccgctcgtgaagacctgactttcatcgaacgggcggcgtttgcactcaaactggacgagggtggttttcaacggtcgctaatacaaatggctttgtctgttgaccgacacgaagctcaaaagctggtaacagttgctcgggcagttccgcagtggttgattgattccattggccgtgcgccgaagatcggtcgaccgaggtggcaggagctcgcagaacttttgaaagtcccgggcgcagagaagaaggcccgcaaagccacccaggacaaatccttctcacatagggattctgacaatcgtttcctggtcgtcctaagagcgtccaagatagatgatgtgacggcgccgtctgtagcccccacccgcttggtcgcaaaatctgctgacgggcttcaaatcgcgacgctcgccatcggcggcaagcagtgcaaaatcgaaatgaaccgagatagagacgagacttttgcaaagtttgttatggagcagcttcctgcgctctacgcgaacttcagaaaggaaaatccgtcatctgaaggataaataaggataggaacagcaaaagaaaggcccccaaacgtcgccgtcgtggaagcctctctcaatggtctaagcagcctgagaatcgcatttccatgaatcgcagtcaagagtctttggcaccgtttttggtgagcagatttcttttgcctattgaagggtgaaagacatgcagagtggaaatgtgacgacgccgtttgggcggcggccgatgacgcttgccttagtggcggcacagttcaaatccgccgacatcaggcagggtaaatcggccgacaagtggaagatctatcgcgatgcttgtgacgcgcgatcattgttgggtttgcgcgatcgggcacttgcagtgctcaacgcgcttctatcattctaccctgaggctgaactcaaggaggaagcgaatcttatcgtgtttccgtccaatgcccaactcgcggcacgggcaaacggtatcgccggcacgacgctacgcgagaacttggccctcttggtcgatgcaggtctcatccaacggaatgatagcccgaacgggaaacgctatgcgcgcaagagctcagatgggtccatcgagacagcctttggcttcagtcttgcgccgcttctggcccgatcagaagaacttgcggttatggcccagcaggtcgcagagggtaatcgcaagctcaaaatcgtcaaagagcgcatcacaattgcccgacgggatgtccggaaattgatctctgcggcaatggaagatcacgttcccggggattgggccaaggtcgaggagctttatgttgaagccatggcacggctgcggcgggcaaaaggggcggacgaattaatcggaattctcgacgaagtcgagatgctgaaggaagaagtagtcaatctattggaacggcacgtcaatcttggaaaatccgacgccaatgatgacggattccgtcagcacatacagaattcaaataccgaatccagcaatgaacttgaaccttgctctgaaaacgagcagggcgcgaagcagagtaaaaacgttgaactaagagccgaatcgataaaatcattcccgcttggtatggtccttcgggcatgcccggagatttccatgtatggtccgggcggagcaatcggcagctggcgggaccttatgatggccgccgtggtcgtgcgatcaatgctgggggtaagcccgtcggcctaccaggacgcctgcgaagtaataggggctgaaaacgcggccgcaatgatggctgcaatcctggagcgggcggggcacatcacatcggccggtggatatcttcgcgatttgacgtcgagggcgaaacgcggcgagttttctctcggaccaatgttgatggcgttgctgcgggccaatggcggcgaacaaaggcgggcttaatcgcggttccaaattatatcccttgaaaaacattagtgccctttgaaccgccgctttgttttgttgtcagctgaccacaagctaaattgttgtttttgctacttggttgcaataatagcattctaaggtgcgattttacttcgcagatccattcagaatggcggcccgttcaggtgcgtgagcgaatgcgagaccttatatccatgcggacgctccgcgaccacatatttggatgcgttgcacagtggggagtcatatgttggcgaagcttggatgcgatcgccgaaagcagccttctgcatgcagccatcccagccagtaccttatggcgtttttcccggagaccggtgttgccaggcggtgggccttttgcttgcgcagctttgatgcctggtttcgttcgcacggagatcggtacgcgctcaacttgtgctgtggcggctagtacctagagagaaagacgctccgctgcgtcgatatcccgatcggacctcgcagcgaatgaaatagaacctcttcaagtcgatccttcgatcactcggaagatggctgacggagtggcgagttctcgcttagaccaatattgatggctttgatgcgttctcatgtccagcagcgtcgtgttggctagcaaaaccaccgaacccgggcactacaggattcgaacacatgagaactggtttctagattggagaagcccgacgactatgtgttcagatcgattgtattatcacgggtcgtgccatctgattcatggaattagtccgtacaggtggcaagaacaattgactcttggatcgcgctggcaaacaaagcagcgatgtacagaggatgaataattgctgaccaagaaatccagacccaggatggcgccgtagcggcagaagctgagcccgctgctccgaaaaagacttcaaaaaggaaataacacgaaggctgaaaaaattcgtgcgaatgcgtcgaaactggcgaagcagaaggtccgcggccttaccggggaggaaaagctggaaaagattggtcagattgaagctacggtcgctggcggcgcaaccttgaagatgccgtgaaaagcgctggtatttcggatcagactcattatcagtggaagaaggctttggctcaaccggcgccacccgtttccgcagcatctctttcggtggatgacgaactcgccgaattcatccagctcgaggaagaaaatcggcgcctcagaaagctgctctcagagaagctgcgcgccgaaaacgctgatctgcgcaagagacatggtatgagttagcggtctttcggtgtccatccctcgatcaccttgacgtgcaatcctcgggattggccggtttcaaaaattcccgtgcatcctgatcattctgcgccctcactcattccatttcttaggaacatgcgaacaccacgatccaatttcatcgtcgaatataagacgaacaggcgccagacacttcgccgaacctcaatctggggcgatctggatttgcaggctgttgcccgcgcggtagaggctgacgatgtgatgccaaagcttgatctgcctcaagcagcatcagttcaggaggacgttgtcgcggtgaagttcgaggtggtagactactcggatgttccgattgacggcgaagtccctccggatagtcctgccgcaacgtcgtcgtcgaaagagttttccatcgagtctgaagctgtggaagacgatgcgtccgaccccacgcgctcggtgcatcagcagcgtagcccgggttcaggatggactccgaagtctggagcgaaagcacggagtaagaagacgccgtcagcgagccccgcaagtgcaccaattctcaatcttcgccgcgatcccccgctgctgtgcggcttggatgaagagctcgccgctctcgaggctgaaaaccgccatctgagaagcctcatggtcgtgaagctccggaaggagaacgaaaggctgaagttcatgcttcggcgatttggtcaaagtcgctaagtttgattactagcacgaacgagtatgcgcatcggtcggcgaccgctgaacccgcagtagcaggcgtctaaggcgggaatctcgtaaattcggtggttgatggtgtcgtttggcatttaatcgtaagaacgcggccgttccggcaggtggtggcatttaatttgagattttcggtgcgattttcggcgtctggcaccttccgatttggcaataaccgtttgtgacggtttagcattttctgaggacgattggccgacggcattcatcttttccatggcgacgaatctcaccttaagtgccaatcgaagcctgaatctcaaaattaactgctcaatctcaatttaagtgccacgctatcttgttgaaattatcgcatgcggagtcttgcgattaaatgcaaaacgacacaagactcccattatgttgtcgtccattcgggcgcctccccggccatctttcctacgctgcgaccgctctgtcgacacgatcgccttgacttggtcttggccactgtgctcgtaagcaatgacgacgtggcgagccctggacacgacttagccgttgtaacgctcgatgaggtccccggtggacggcccgaacattctatcgaatgtcctgctgctgtcgataggccattcactgcagccaaggtcggaacacgttgaaaggtgggggggatcgtactactatatagttggaacgaaaggcgatcagcttcgatgcagatagtgtggacatttacagcgcggtcatacctcgaccaactcgcatcggaagagaaagcaaaggtggtcaacgctgttgaacgtctgtcgcgcggcggacgatcctcagctctggagcaaacaaagctattgctcgggacgaaagatctcttttcccttagggtgggagccgagttgcgagtcctcgttcgcttcgagggcgaaaatctaaaaattgaggacgtcgttaggcgtagccagctcgatggattgcggagagttgagaggttggcacaggcccactctgtatgaaatcctttgtttccttaaatcttgatacttcgatcttacgacaaaacctggacgaacttgacgagctccttaaatccgagagccatctcaaggaacgggatcagatagcgccattttttaaagagcgcccgcatctctgcgctgctattggctacggaaacaatgctgtcgaactacccaactgctgggcaagcgaactcgacttgtttggcgatttcgtgtgcgacgcggcttctggcgatactgaggcgaatgcattcacattgatcgaggtcgaggacgcgcgagaatacagcatctttacaaagctcgaagccggaaaatcaatgaaacactggtccaaccgatttgagcacggctcgtcgcagttggttgattgggcgtggcggctgtcggaagaaaaaaactcttccgcattcagacggattttcggtacgaatagcccgacaattcacctgcttctgattgtagggcgtgatgcggatctcgtgccagatgatcttgatcgacttcgctggcgtgctaacaatgttgcctttggtggttatcggatgtcgtgcttcacctttgacggaatactagcctcaatccgtcgtcgtcttcttctggcaagccagccgtcagaggtaacctgaaacgtttgcgagatccggctgaaggcgccaagcccgcgatcttacaacggccccggcgtaacaatgaaaacggtcatcatctaaattacagaagtgctcacaagcccgagctaagttaggctgcttctcctgagtagtgccgtttgagatagacttccatccccaactgaatttgcgcgaaccaaggtcctgacagactcataacaagcgcgccgcgcgtccacaccgtctggtggcattgctggatgcctgttgaatcgagcgatgacgtgactgctccatcgcctcgggtaggggaatgcctcggttcgccgcctcggccagatacctgaccgcaacccatgggccgaaaactccccgctctccaacccggccatctccaccctctgcttgataacggcgttgaccgactgcggatcgagcgcccgccgcgaaattgtcccccagcgcccgcccccccccccgaaacacgctgcccttgtcgatcttcccccgccgccagccaggcattcaacgcctcgacaggccggccggtgagatagacgactcgtcctcctcgcctgacgtcgttttggtacggccaagatgaatggcgagagaggggaggggagtgccgccttcggtctcgatcggagcttccacggtcagttgttccaggcgaaggcctgcgatctcgctgcgccggcggccgccggaggcaaaggcgaccatcaggatcgcccggtcgcggagatcacgcgggctttcggtcgcgcacgtcaccaacagcttggccagcacgtcgccggtgaccgcctttgcgcttttgcggcggcgttgccgcaggacggcgcgcacatccagacgaacggcggattcgagggcaggggagccgaaggcgtcggtaagcccgcgccatctggtcagtgtcgaccagttcgccagccgacggagcacggtcgccggcgcatgtgggccggcggacttgaggaatccctggtgccggaggttttcggccacgtctgccgggatgccgtgatctgaatcggcagtacgtttctccggatcccacaggtgatgggtgacgaatttcaggagcagcgcttcgggcgccggccagggtagagattttccggaggccgccagaccccaggcttcgaaataggcgagatcggaggtcagcgcccggagcgtattgtcgcccatgcgctgtgtggcttttagctaacaatttcaattgaagcggaaagctaaaaatccgacacgcaatttgccccaacgagttcatagtgagcaggggaggggcctcaaagccctgtggctttggtgagattgacgcgaaagcggtcacgccggcgctggtatttccgcgtcatttccgcactggcatggccgagctgcttctggacatagcgctcgtcgacctccgcggaggaggccagaccggcgcgcagcgagtgaccggagaattttgccgcgcgttcggcctcgttgaggtcgcccctgacgccggcggccagtgccgcctttttgacgagacgggcgacctcgcgatcgttcagccggtccggtccgacatccttgccctggccgcggacgcggcggaacagcggacccttggcaatccgggcgaacttgatccaggtttcgatagcgagaaccggacaggtcgcatcggacgagccgcggccgacttccacctcccgccatccggtcttgccgcgcagggtgacgagcaggcccttctcgaggatctcgatccagccgcgcgcgtcctcgctctggtcgcggccgatatcgagcccaacgatctcggaacggcgcagaccgccggcaaagccgatcagcagcatggcgcgatcgcgcaggccgcgcagggttcccctgtcgagcgtttccagcatgccgatcaggtcttcgggcaggagggcttccttctgccgcggcggggcggcgtgcgtgttgcaaatgccagccattacggtggcgatatgacggtccttgcggtcgagcggcgtgccgcgctgggcgtagctccaggtcagcgccgaaaggcggcgctcgatcgtcgtgacggagctgggcttgcgatcggccgcagcagtgccggacgcgagcgccgtaatgtacaggccgacggtgtgcggatcgggcggtaggggcgcgagaccctggcggcggcaccaagcggaaaagtgcttccagtcggaggcgtaggccttgcgggtgttggcggcgctcgccgcctcgacataggtacgggcgcgttcggcgagctgctcgaggtgcgccggcaaggtccgcgcctccggaagaggggaggggaggccagcgctggccgtcgagatgccgaccgccatctgcggcgcggcaatagcgtcgcgagcggtcgtgctctcagacggagaggaggtctctgtggcgtgattttcgtcgttttgctcgatgatatgggccattctttatataaagagcaaaacgtccgataatgcaagattatcggacgttatatatccgcgacaagcggtgcggtttaggcggataatgctggactaaaccgctcacctaatctacactccgtcgcatggattcgttcgacccctccgctccaaccgcccccgcctggtcgccccgcatgccgggatgggcactgccgcgtggtcgcgacatcactgaatccgacgccgccttcgccgccggtatcgccctgaaatcgctcgatgatctgatccgcgccgatccgccgtggctcggctgctggcgcgatcgccttgctctcaaatcagctgccgtcgccgccagaatgcttggccgcaatgaagaggaaaccgccattcgcgacgcgattttgctcaccgcgcccggcaacgatcccgggccggccggaaagctgtttcttgccatacgaatgctgacgcgccaatccgggacgattgccacgccattcgttaaggagctctgcgcgctgctggggattggctgggaggatgctcttgtctccgtcccggattttgtcgatacggcgatccagtccgggcgcgcggcacccctcgcagttgccgagcttgtatcggcgattacgaccattcgcccggacaccgaggtgctgtcgcttgggctcgccgagatcgttctggcgctaatgctgaactggccgaaacccgtaccgctgctaatccccgagcggtttggcgaggcgttccgcaccatcggcggccgtggtcgcgtccggtctggcgaagcggcttatccgagggcgatctgcctggctttgatggatggtgtggcggcggcgctgcgatctgccgtggagatcgatcgaagggcagcgcggttgctggctgtggcaccaaagctccgtaccaggggcgccgagccggtgatccggcgtttgctgtccgacgacgctattctggcgtcggtcccaggaagcgagctgtcgcgctgggcagcgaaccggctgttcgatcggctcgagagttttgaagcggtgcgcgagctgtccggccgctcctccttccgcatctttggattatgatgatgaggggagcgagcgcgacaaaaaccacactgcgtcgggcaaaagaccgacagcaagatgtcctgtatgatcgcgagctcgaggacttaccgcaagaacttcgttggcgggaatggatgctgcggattgaggcggtgatctttgcctcggctgagccggtcagccgcgagacgctggcgcgtgtggtgggaaaggattgtagcattgatctgttgatcgacgatctcgtcgaggagttgcgggatcggccttacgagctggtgtcggtcgccggcggctggcagcatcgcacccggccgcggtttgccgagacgattcgcgcgtcttcggccccgacaaggggaggggcggcggcactctccgagttcgaggcgatggtgctgatggcggtgggatatttacagccgattacccgcggcgagctgtcaaagatctttgggaaggaggtcagccgtgacgtcgttggtaatctgcgcggggcgggttttatcggctccgggccacgcagtccgacgccaggcgcgccctatacttacataacgacctcacactttctttcggtctttggtatggagacgttgcgtgaccttcccaatatcgaagcgctcgaggacgccggcttgctgagcagacgtgccgttcaagatgatgtcgccttcgatccaactgaaggggaggcaatgttcattgaatgaatgagggcagcgtacttctgcatttgcgacccggacgaaggcgctgtgacgggagcaaactgcagaatttcgtcttggacaaccgtgctgtcttccaatggtccgtccgagagaccttctaaggcgaagtccgaatgggaaacaggtccccgccgtagtggtgaagcctggtgtgatggcgacggcatagccatcggacgttcaatggctcgtcgtattgatcgtgatgagcatcgacgtcttcatcaccacagacctcacacgtgttctttctcagctcgcccgccttcacggcacgctgcaccaagaggtgagcctcatattttgcaggattagcacgccgccaattcgcttggcgggtatctgtctttagcatctatctagtcttcccgatcagttcagggtgtagcgcttccagggtatcgcctgcattggcacccgcgacagaaaattaacaagatcacgtcggccacgatatgtcggtacgcccctgctgttttgtgccatgagaacaatcggcacgcccgggaatgctggctggaagctatatgcaacgtcgtcggcctgatggccgctgttcaaaacgtgcggcttgacgatgactatggcgaaggtgacgccctgctcgcgaactaatgcgccttcaaactgcatttcttctctcctttgatgaagaggccgcctcactccaggcggcctcaggttttagccacgcggcgggaacgggtcgcgaccgtaggaatccttgtcccggatttgtccgttgggacggtggatgacgacttcgctctgctggttgatcgcaattttgcgagcagcggcagccgcgtcggcctgcgttccatgggtggaggtcactcgctgatttccagcgccccgcacggcccattcgccgttatggggaaccacatgctgattcttccttgtcattgcatcagaatcttttttcttgagtgccgtaagagtttacattaaggaaaatttaattgtcaatatggctattgtggtttacgaatggatgacgaatttttacgcatggagtgatcatgaccattgagatgaaaaatgtgctggagttggccgacgcggcactttccgctgactacacgcgcgtacgcagagctgcgaatgcgcttgcgcgagatctcgacaagaatggtgagacttccattgccaaggagctgaaggccctggtgcgcaagaggggggtgcctttgaaggcgtctggctacgtggaatcgctgcccgtggactcgaaatcccgcttgccgcttgtcgaggagcagacctggcccgatacgcctatttttctcaacgaaggcgggtggcatgtgttcagcgatttcatcgcggatgctcggcgcattgatgacttgagcgccaaaggattggcctcacgtcttgggcttctgctctctggcccgccaggaacaggcaagtctctccttgccggccatatcgctgcgcaactgtctcgtccgctatatgtcgtccggctcgactcggtcatctcctctttgctcggggacaccgccaaaaatatccgctcggtgtttgatttcgtgccggcgcgaaacgccgttctttttctcgatgagatggatgcagtcgcaaagctgcgtgacgatcgtcacgagttgggcgagctcaaacgcgttgtcaataccgtcattcaagcgttggacgggctagacccgagctcgatcgtggttgctgcaaccaatcatgcgcatcttcttgatcctgcaatatggaggcggtttccttataaaattgaactcggtcttccggatgaaagcgttcgcgctgacctttggcgccattttctcttcgaggacaaagatgaggagaggcgcgccgagctattcgccgtcgtgtccgaagggttgtcgggggccgatatcgaaacgatgagtctgtcggcgcggcgtcatgccgttcatgagtcgcgtgatattgattttggagccgtcgttgtggctctgctggagccgcggtcaggccgtactgtccctgtacagcggcagccattggatgcggagcagaaacgccaggttgcaatagccctcaaggagaagtacgccattgggggcgcggataccgcccgcattctcggagtgtcgcggcaagccatttacgcttacctgaagcaacaggaaggggaggtgtagtatggtggagcctagagaccaacctcttctctatcccgttctgagccttcagatggatccggcgctgcggagtccgacggggcgtggcaaaggcatcgacagcatcgtcaaggagcggctcggccggcagcaggacgtgctcgcgagcgaaacacgcgacatttatgaacaccgtacagagttgcccacatactcgggtttgacgcacctagtcgttcggatgttcagtgaggattcccttgctccaacgcacacccccgatgacttgttctcgcagcgtcatggatgcaggctagttgctcctcttcctggcggctatttgatcgaggctgaagtcaaagaattgcctcgcctccttcgcgcaatcgaacatccaatcggctatgcggtgcaagccgacatatcccgtgtttcgtctctcggacaatttgatgcgaaaagtcgtctgcgcggtcgatcgttcaatgagctctggaattccgcaccggaagatgatgacggacgcttgttcgttgtttggcttgcgccgttccgcgatcgagatgccaaggccgaagtcctcgagcgtatccagcgctttgccaatgagaggctggtcatgccgacatttaccagcgtgcggctcacgctcggaacatctgaggaatcggaagaaccgcgttctctcacgacaccacgacaatccagcattgcaagggcaatgcgagattatcgaaacaccggcgtcggacgcgctgcagttcgaattccgaataaagaagggttgagacagctcattgcgtcaggcgcttcttatcgcattgatcctgtgcggccgatcagagtggcagcacctggcgaaggagcggagcctcctgcaccagtaatcgatgagaatgctccaatcgttgccgtcgtcgatggcggtctgcatgcgcgaagctacaccgcagctgaagctttcagggcgacacctttcgtcacgaacgcccaagccgacaagcctcacggaaatagcgttagctccctcgttatccatgggcacgcctggaacaaaaaatcgctcgctgcctcaactaaactgccgtatcggaactgttcaggccgtcccccatcggaacgccaatcggcgctttgatgagcgggagttggtcgactatctggcggaggttgcgcgtctttatccagaagcgcgcgtctggaacatctctgccaatcaggacggcgccggtttggatcccaccgaggtcagcgttctcggccatgaaatcagccttctcgcgagatcggcgggcttcctccccgtcatctctgtcggaaatgtcaccccagataacaattcaagacctaatcccccagcagattgcgaggcggcgattgtcgtggggggccgtcaggcgcttgctgacggtacgccgggtgacagttgccccgcatgcctgccaggtcccggtcctgacgggatgatgaaaccggacctgtcgtggttttcgaatctcaggatgctgggtggggtcgtggatacgggaagcagttacgcaacgccgttggtatcgtctttggcagcccacaccttcgatagcttacgggaaccaacgccggatctggttaaggctctcctcatcaattcagccgagcgaagtgagcacgatcccaacctcggttggggaaccccgtatcaagggcacctcccttggacctgcgcgcccggcagtgtcacgcttgcgtggcgggcacaactcgagccaggaaccgcatactactggaacgatattcccatccctcccgagctggtgcgtgacggaaaattgttcggacgcgccagcttgaccgctgttttgcggcctctcgtgtcgccgtttggcggcgctaactacttcgcttcccgcttggagacatctctggcgtatcagtcgggagcggataggtggccgtcgctacttggctcaatgaaagagtcgacgcttccggaaaacgacgctcgcgatgaacttcgcaaatggcagcctatcagacggcactgcagagacttttcaaaagggagcggacttggcttttccggaccatacctgcggctttacgcccgcgtgttcatgcgtgacctctaccaatttgggtggacgcatcacagccaagcgggcgcgcaagaagttgcgttcgtgctcaccctttcaagcgcggacggagagaagtcgatttatgattcaacagctcgtgcgctcggaaacttcgttgaaagcgccgtcttgaaccaagacatcgaggtctcgaatgagatctagctggtcggtgtcctccggatttgcgattgggcccttgcaagcgaggcagatgcgtgaggcgtagccgcatttccatcggtttttccgagaaggaatttgccgaagcgttggcacccagggtcgctaccgtgggcacgaggccggtggatgccgttgaacaactgctcacacaaattctcgtcgaaaatcttcggcagcaaacagctttggcgctccggaagatcccctcggtgaagcttcactcgatgtatttcaaggagcgctgtgcatccttagcgcggcttgcggacatcgggtacgacacctggtatgccgaactggccttttccacaaccagagagaacatggttgacggcgttgagattgacacacagggtttgcacctaagtcccataaattgtggccctgcagggctgatcacacaccgactttggtcgaagcagctaaaaacgcaaaccaatcacatcctgcgtttgaaccacgtgacgattccgcccagcacgtttcttgaaaccaagaaaatgatggaggcgatttgccttgagcagccgctggtcgcgaaccctcgacctggtccgcgtacgcaaggctatgagtttgggatcgagggctttgagtttgttgcattcgatcatttagttaccgggaagcgttgtttctgttcatgcgctcgcctagctcatgaaaagatgatgtcagaggctataaggattgcatctcattcaggcgcatggacccatcaggttgttcgattgttgtcggatgcgacctacatcgacgaaatatgccacctgtgtatcgcccgtcgctcgggaccggaggctgctgccagcttctacggtgatgatattggggaatttatcacgccgtatatcgatcagctgatgttgatgtctggaatggacaagtccactgcgcgttccgaagtccagtacactcttggtgttcgccgatggatgagggaggcagaaatgtacagtctggtgaaaaagctatttcccgaccaagttatcctgagggaggcgtcgcccccatggctggggcgccaacgatttgacgtgtatctgcccgccatcggccttgctctggaacaccatggtgagcagcactacagagccattactgcatttggaggagaagtggcgctaaaacgtaacatggaacgcgacgccttaaagagaagtctctgtgaacaaaatgccgtccaacttgtcgagattcgatttgatgagcaaatgacactaccgcttcttcgccgaaagctgcggcgtttcattatggcctaaatgtatcaatgacggccgccttcacggcgataatgtgagatattgatttcagtcgcagcctggggtgtaaaatgttctacgaacgcggatgtaacagaatatctcgattatcatcttgcttcggaactggagaccgatttcgcgattatgttgatcggcccttggggagctgtaacgatgccagtcacgagagttgagcgaattgtcggcggcctggtcatcggacgtgtcgaacgcggctccgacggctactacgcctgtcatcatttcggatcaaacgtggatcccttaccccttaataccttggacgatgttgcggacttccttcgagctcatcctcgcggcggcgtgcgaatgtatccaggtcggaagaagatttctcgcaacatctatatcgatggaattttccttcggtgacaggtgcgcgaccgccgttgtcctgatagttttggaggtcgctactcccgatgctgacgcattgaatgtatcaggctttcatgcattacggatctcctaggaacggtgggcattatgcgaagagacgaggttggggaggacctagtgtctctcgcctttgactttctctatttttttgcgcgtttcgaatatgcgctcaaggccaacggttacctaaagaaaacagagccaggtcagcccgcggaggctgggtggagacaatttcgagagcgctgggaaggagattataaaagcagcgaagccgctgtggcgttgatcgcggctaacccgaaaaagcagatcattggcgacgatggaatgctggcgtttagagctgtgggttttcccgccagtacttgtgagcttgggcaggttatcggctattgccagaccgtccgtaacaacctctttcatggtgggaagagcagtaccgacggcttcgatagcccggagcgtacgaaatgctgctttccatcgttctcgtcgtgctcgaggaactggccagcgctttcgatcttggtgctgactataccggctactactaaaacgctcatcgatgaagagtagacgcaggcgcttgataggcagaggcgtgaacgtggaatgtcgttcaagaacgcagcaggcgtgattttttactagccaaccttgatgtgcatcaaaatgtgcatatattgtgcataagattgagcggagattaggcatggcgcaggctcagacagtacattcatacacagttgtttccggctttgttgatagccttcaggaaccgcggacgccctatatttcgccgtctcgcttgtcaaaggcgctcggcgtcaaagtcgcaaaccttgcagaattgaccggtgtccatcgcaataccctgcgcaatccctcctccgaacgcttgcagggcaggatgcgggaaatgatcaaggcgatctctgcggccgccgagctgactggtgatcttgcgaaggcaatctactggtatcgaaatgaaccgattgccgattatggccatcgcacggccgcggagcttgttgccgatggtgagatagaggctgttcttgcctatattcgggacctggagaatggagcgcgcgggtgaagattacccgcatcggcccgaacgcagtctttcatcggtatctaacacctaaatgggcgtttcttccaaccagcggcgccggggccgctattgacggcggtcgcttcaatcgacccggcgtcgaggctctctatctttccgaggccccccaaaccgcgctcgaagaatatcgacagggcgcgagcatcacaccgccggcgacgcttgcagcgtacaagatcacgctcagcgaagtagccgatctgtcgcaaggtttcgatccgcttctttgggatgcagcttggtctcaatgggattgtgcatggcgaaaaatcgctcgcatcgacaaaaaggtccctccctcctggaagttggcagacaaagtcatttcatccggccttcgggggctgctctttccgtcactaaggcacgctggcggaactaatcttgtaattttttctgccaatctcatcccagatgatgacgtgcatgttcacgatccagacaatcgtttgccgcgcgatcaattgtcctggccgcactagcagcaatagatgccggccggcttcgggggaggggaatgaagcgcattagtatcaaaagtgttcagcctggagatattctcctcacagctcgaccgggaaagataagcaaatcgatccgcttcagcacggggggcatcgtttcacacgcgatgatctgcgtgcagcatggttcgtttatcgattccaccgcggacggggtacaggcgcgcaacctgcagcgggagttgttcgaggatgacgagcaggttttccatttccgcctgaaggaagctctcccccgcgaggtactttcaaatgtaatcgatttcgcgcgggccgagatcggtgcgcgttattctgtgccggaggccatgcggtcggtcgctgctgtccgaaagccgagatcgaagcggcaatattgctctcgtttagtggcccgcgtctacagaaacgcgggcatcaatcttgtgccggacgcagactattgctcgccggaggatttacgacgtagtcgcttgctggtggaaatcccgatagagaccgaagccgtgtccgaggaagaatggcgttggctcgaaaccaatcgtaacccgatccgagatacacatcaggcccacaaagccattcttgacgtcgctcgtacgttcgttccggacttggagagcctaaacgaactccatgctttactcgtggttcgccctgaggctgatccggagattgcagaggttctgcgcgagagcggctaccttgatctgtggcgcggtgaaatagcggctcacccttggcgctacgaccagagcctaatcgcaacgatgtccgcgcccgagcagatggccgacatacgtgaatactgcataggtacagtgagcgaggcttacagcggaggcgtgcggttttccattaacctcatacagttgcagatgctagagacccagcacggcggtcaatccctccggctgttggtggacctgtacgaaactcttgtgcttaacgatcagatccgcagggaggtcgcgtgtgcgtggctgttgaagcactatcctgacgacctgaagaaacagttggagcagatcgagccgcacagcgcctattggtattcggtcgttgatcgcgtcgaaccgaagctggccgcgttgtcgcgcatggtcgtcacggcggaaggaagttcggaagtctgctcgtcatgcggcgaccggccagccatgtcctaccgtcttgcgaatggcgctcagacgatgccgggcgtaccctccctgcgcctgtgcagcgactgcatcgagatacggcgcggtatgggcaacatcctgatgccgttcctgcattgacttggaaagagaatgggaccgcaaacgaaggctgtgataaaagaggatgcgctgctttgggtgagttaggccgttcaggaaacagtgttctggacccagcgcaactgcgtcggatcgaagccgtgcatcgcggctacttattccagcacctctatgcagttcaatgtttgttgtcagccgcaaccatcgctgcgcgggagatcgctgtcgaaagcgacgaagatgtagaaatccaactcgatggcatccgtatctatgtgcaggtgaaacatcggaaagatgcccttgcgtgggatgatatcgagggcgcgatgtcacgttttgcggaccttgccgctgattcgacgttagcctaagacctatcgaccggctatagccgaagaaaaatagcgggatatatgcgccgactcgccggctgtgttgatgaaggctagctcgcgcgatcgtggccgtacatgcggagccttttaactagcatcgttgagaaggtggcgcgtttgtgatccttaatcccgcctgccgtgttcatgagcagatccgtcaacagcgcattcgtttttctgcaatgcacttgaagaagccgattgccgtgatatggcgccgtgtccagtaagattgccaatctctgcgccggcgggaggggcctattccctcgaccatcagcgacatttagatcgcgacaagtagcgtcacctcgcaaagttggagaaaaagagggtggctgtatttgatccgctgggctggcaggggcgctagcgttggcgctcgttcatgcagccaacctgcatttcaagtgttgcaaaagtaatagattagcagtggagacgcccttttcatctgagtaaggttagcgtgattgaagaaaaatggagcttctcatgccgtccagcagccaacgaacacctccccgagaatctgagtctgctcgggtgaagagtgatcctgcgtcaccaaaccgaaacctaccttccgatgtacttgcaaaagttgctacctacgttccaacccaggatgtggtcgaaaccgcacgagatctcggaaatctagagcgaactggctccgcaggtcgcgaagctttacgtcgaggccctatcggaatttatcacgctcgcgtgaaaaggattggtacatcggcaaaagcagtcttcgatacaatcatccctggggagcaattgcctgattggcaggtgaaccggccatctgaaacggcaagaacgcgggcggtaggaccacttctgaagtttcaatctgaggctggaaaagcacgattcacaaccaacatcctgaacctccctcagcctgatcagtgcgacgcaattctgagcgtgataaagcatctggacgatcttggggaagtcaataagacgcgcttaatcgaacgttcgatcgaaatcttgcagcttgatccccctcttacttggaaccagggtcagaaatgccccgccgcagacgtattggtccagggcgagaagcacttaaacgacgaccaaaaaactcgggtacaacacgagaggaacaatcgcccggagctgctgcgcctgttccgccgggctgtcgcagactttgagattgaaaaaaacatggcggcgcatccccgcaggtatcaagacgcgaaagaaccggaggtgaaacctatcgacgaggtgattgacataatcgaaagatatagtcgatcggtcgtgacgagagggccaaatgctatcggccttctgacggcacacgagagtttcgtcaagaacgtcggtgatgcctacacccgtacgcgcgccgaattcgattcatcctcccgcgatcgggacagatcggcattgtcacggtaactctcggcagccgttccgtgttggcgtgagtggagggattacaaggtgacttgtccccgctgtgctccaggtttcattcgtgtttggtgcagtcaatcggcatcggcctcgttgcaagctgtgctggtccgaggaatgaggattgattggcacccggaacggcttttccaaggggaaaacgccagccgcaatccgcagtaggggctttcatcgtgagattgacataggacaaggctcgaccggagatgtagaacaggagcgcgtgggcgtgctgcccgacgctcgggtcgtgcgtcccaatagccagccttggattgctatcggagccggaaaatccaacactttgtttgtgtacttttctaccacagcactgaatggtgtgccgtcctgcagcttcaacacggcacgatgttcgagaagaaacggtggcaggaccagtggtcctctccggttcgcagttaattcatttcccatgtcccagccttctggtagaggagaccaaagcagattggaagataggttggtgcgggtgaagttaagagactgaacggccctgccgaacgctatatcactggtgctcaacgcgttattcatttccattgtcagtctcgccggaacataccagttgtcggcttctgatagtacgcgatttccgcaaaccaggcgaacgcggcgataagcgataggctcctctgatcccacggcaagaagttctcggatactgctatcggcgggcgtgtcttgtacgcgcacgcgctgggcaacgatcttggagtcttccggggcgagtttgtgcgcggcacaccagcgatcgagcgtcaaggtggcgctaggatttcccaggagatttgcattcaaggtctggagaactgcgagcgcctcgatccgagcggttggtgtgtccggccatggagaggcggtggaagattcttgtgccaaggtattcgcggccagcacgagcgctatagtcgatgcgattgctgttacctgcacagactttaagcaaaaattcgacatactgaattactccctggatgtgcgtgggcgagttgaatgttgatcttggggaggactggaagcatcgctgttcgcggagtggccagcggggcagtttgttccggctttcgtgtctgctcatgcatcttccgccggccgcccaatcgttctgattgtccaccgttgagttcagctcgtttggtgtactggaacttctagcgttccttcgaggttggttaaatgtcaatcgtgttacaaatgtaaagcattgccttcggacgcgttgccgttggatgtcataccgaaaaaactacgttggcttctcattacttcaggaaattcgagtgcactttgtttcggattaagacgtagatgtatgtaccaaacggctttcccccggtcagtcgcccactcccaccgcattgacatggcaatttctgcagtcggttattgtatcacgacaagccataccgctttgaggcgccaaggcgtcgttggaagtcgtcatctctcgacattggcaatggggtgcgggtagctttggaacatttgatctgaatccgcgtcaggcgcggcgcattcgtaaacgagaaccgattcaagcgtcgccgccttgaactccttcggcgagtggccgccatcagttctcatcatcgtcttttgctttcgaagtgaaagcttcatattgctgtagtggataaaaaaattcacatccgtaggcaaagtccaagagcaactgttgaaaaaatgatctttgtagcgcaacggttggtccctcgatctctgaagcggttggcaatcttgtcgattgcgtgccgtcgacaccagccggctccagatccgagcggctgtttgcagtacctggtttttcgttcaggctcatggttcagtctccttgtacagctttcacccctatgcaatctgaatgtgctaaaatgatttgccgtgggagaaggtcagtttcagctgtaatccaacggggctggatgaatgcggctcgctctgcattagaggcagatattggtccgaacctgctcgcaaagtcgggacaatcccttgtttgccaaacactgtcgagagtggtcctcgccggtcgccgtcaggggccgcgtctaaacgataatctgcgatcccagttcaacaacccggttggcaggaaggtgaaaatagtctgatgggagtgaggccgcattcgcaaggaggatgtagaaccggtcctgccagtagggcatgcctgaattggcgtccggcaccagcttgcgccggccgagatagaatgaggtcgacatgatgtcgaacttcagtccggccttgcgcagcgtcgcgagcgcctgtgagacgttctgcgattccatgaagccgaacagcagttcgacgcgcgagaaacgctcggaaatctgctcgaccttgtaacggtcctgactcggcacacgcggcttgttgaccgtgcggatcgtcaggatgacgttgcggtcgtgcagcacgtgattgtgcttgagattgtgcagcagggcggcgggtgcggattccggatcgctggtcaggaagatcgccgtgccgggaacctgggccggcgaatgttcgctcttgcgctcgatcgagctgacgaaggaggcgagcggaatatcggtgtggcgggtcttttccatcaggatcgcagtgccgcggcgccaggtccacatgatgacggtaaaggccgtggcgatcaggatcgggatatagccgccgtcgtggatcttcaaaagattggcgccgaggaagatcaattcgagtatgaccagcggcgccagcgcgatcaccgcaaccggcagcgaccagttccaacgggcgcgaacgaattcgaaggccatgatcgaggtgacgaccatggcgccggtgacggagatgccataggcggtcgccagcgcgtccgaggttttgaaactcaggaccaggaagatgacgccgatgaacagcacggcattgaccgagggcacgaaaatctgcccggtattggtttccgaggtgaagaggatttccctgcgcggcaggaagccaaggttgatgccctggcgcaccatcgagaaagcgcctgttataacagcctggctggcgatgatcgtcgccgcggtcgccaggatgacaaccggcagcagcgcccattgcggatacatcaggtagaagggatccgacatcgtctccggcttgccgagcacgagtgcgccctgcccgagatagttcagcgtcagcgacgggaagaccagcaggaaccaggcccactggatcgggcgacggccgaaatggccgagatcggcataaagcgcctccgcacccgtcaccgtcaggaagacggcgccgagcacgacgacgccgtagaagccctcatgcagcaggaagctgacggcatagtaaggattgaaggcggcaagaatgccgaaatcgtccgagatatgcgaaatgccggcggcggccatgacgaggaaccagacggcggtgatcgggccgaagaatttggcgacggcgccggtgccgcgcgattgcacgacgaagagcagcgccaggatcaccaccgagatcggcacgatatattccgagagcctgggcgtgacgagcttcaggccttcgaccgccgacagcaccgacagcgccggcgtgatcatcgcgtcgccgaggaaaagcgcagcccccaagaggccgagcagcatcaggatggcggtatggccgttggcggtcttcatcaaaagagcaagcagcgacagcgtgccgccctcgccttcgttgtcggcgcgcagcaggaagagcacatatttgatggtgacgatgatcgtcagcgcccagatcatcagcgagatcaggctgatgacctcgaaacgggtgagcccgtcatgggccaccggcttcaacgcctcgcgaaaggcgtagagcgggctggtcccgatatcgccgtaaacgacgccgatggaacccagcgtcagatagaacagctttttcggcgtcatctgggattcggtcggatggctttctgcggacatgatttcaacaggctcttcggagccccagcctccttttcccgcatcgtttaaaacgcaacaaaggctttcgcaacggcgttggaaaattgaccggtcgaagaattctttgatgatgcaggcgtttctttgaggccttatctcatgatctcaacagagctgaaacgtcggatcgagcttcatctgtaacgctcacaaagttgcaaatccgttcggcaaactgatgcgctgatcgaggaccactcgggctcttaaagcgacgagtttcgcaggggcggctttcagaattgccgatcgcagacgcggcggcataccaagccgctttgaacgacttcaaatcgcgcgcttcgctgaggacgtcaaatttgatttcatttgtaacaggggaccacgcgtcgattgaaatccgaagcgcgttcaacataaaaacatcgggaagacttccttttgaaacgtttgggtcagcctgtcatgttcgtgcgttccgatgctctctcccgtataaagccttctgccactatcgttgtctcgcagaagtttcgcgagcttaaagctgagggcagggacgtggtccgcctcaatataggagagccggatttcgatacgcccgacaatatcaagacggccgccatcgacgcgatcaaccgcggcgaaacgaagtacacgccggtgtccggtatccccgagctgcgcaaggcgatcgcctccaagttcaagcgcgaaaacggtctggaatattcctgggagcagacgatcgttggcaccggcggcaagcagatcctgttcaacgccttcatggcgacgctgaacccgggcgatgaagtcgtcatcccggcgccttactgggtgtcttatcccgagatggtggcgctttgcggcggcacgccggttttcgtttcggccacccaggagcatgacttcaagcttcagccggcggatctcgaaaaggcgatcacgccgaagaccaagtggttcatcttcaactcgccgtccaacccgacgggtgcggcctatacgcatgcggagctgaaggcgctgaccaacgtgctgatgcagcatccccatgtctgggtgctgaccgacgacatgtacgagcacctgacctatagcgacttcaagttcgtcacgcccgttgaagtcgagcccagcctctacgaccggacgctgacgatgaacggcgtctccaaggcctatgcaatgaccggctggcgtcggctatgccgccggcccgctccagctcatcaaggccatggacatgatccaggggcagcagacctcgggtgcgacgtcgatcgcccagtgggcggctgtcgaagcgctgaacggcacccaggacttcatcccggcgaacaagaagatcttcgaaggccgccgcgacctcgtcgtctccatgctgaaccaggccaagggcatcgtctgcccggtgccggaaggcgccttctacgtctatccgtcctgcgccggcctgatcggcaagacggcgccgtcgggcaaggtcatcgagacggacgaggatttcgtttccgagcttctggaatcggaaggcgttgacgtcgttcacggctcggccttcggcctcggcgcgaacttccgcatctcctatgcgacgtcggaagcgcttatcgaggaagcctgccgccgcattcagcagttttgctcgaattgctcgtaagagcgtatcctccagaggttattttatgaatggtagagtttctcaaaaagtgtcggaagagtccgggccaatgatatcggcgtcgatcgacccagacaacgttagtatcgcggacttagatcggttcggccacgctatttttaaagaatggcggccgaagcggcccttcctccgcaggcaggacggcgtatacctcgtacttagggcggacgatgtattgggcttaagtagtgaccctcggacccgtcagatagagacggaactgatgctcaatcggggggtcaacgaaggagcggtcttcgacttcgttcgctacagcatgcttttttcaaacaaggaaacccacagcaggcgtcgctctccttttactcggactttcgcattccggatgattgaaaatctacgtccgcaaataaggcaattgacggagatcctttttcgagatttgaaggagcttggttccttcaatttcgtgggggaatatgcttcaaagctcccagccgttacgatagccagcctgttaggcctcccgccaagcgacattccctattttactcaactcgtctatcgcgttgctcgctgcctgagcccttcatggcgggatgccgactttccggacatcgaaaaatcagcggtcgagtttaagaactacgtgcaagcggtaattgacgatcgccgaacggatccgcgtgatgacttcctctcatcctacataaacgcaacgcgagaagcggaggatctctcgcccgtcgaaggcctaacccagctgatgcttatcatcttggctggaactgacacgaccaaaaccggcctcactgcactgaccggacagcttttgcaacatcgacaggcatgggacgcactgttgaacgatggtactctcgtggccgccgccgtcgaggagggactgcgctttgagcctccagtcggatcctatccccgttcaacactggcagatattgatcttgacgggttcatactacccaaaaatagtcttctcgcactttgcaccatgtccgcgctaagagacgagaaacactatgtccaccctcaacttttcgatattcatcgcaagcagatgcgctggcatatggtatttggcaccggtgaacatcgatgccttggggaagcgttggctcgtttggaattgcaagaaggacttgctacggtgcttagacatgctcccaatctctcgattgaaggtgaatggcaggcggtacagggtcatggaggtgtgcgccgaattgcggagatgagagttggcttcaatcgagaaaattgaagcgagttgctttctctcgttggctgatgggaagaaagcgcataggagtcgccgccaaattcttgtcggaccagcttggtttgttcggtcggtgtttttcaccgtggatgcggagtaatgagaaactgggtcagaccactgggctccgttgattccgcgaaatctgcttagttggattggctgtcagaaggagaggtgaccgcatgatttgggatcatttatcaccttcccgaagggttctgcttgatatcaaatcgtggtctgtattggtactggtaattgcctcgatatcttttgcggttctggccataggatcttggcaagacaacgaaagcaacgaagcgatcctgacagagctgcaatcgatcgacgtggattgcgcgatgctgcagcggaatgtgttgcgtgctcacgccggccttcttcggaattaccatcctcttatcgtccctctggggcgactgcgcacgagcgtcgcagatttacagcagctttttaggcgggcgggcctcgacggggccggtgaattttctgaattgctggcgcgggtgaagagctcagtagatgcgaccgacgcagccgttgcagcgttcggtacgcaaaatgtaatgttccaggattcgttggcgacctttaaccagtcgatagcttcgcttccgaggtctttggatacgagggatttgaactcgctagaagtcgctgagttgggctatctgatgctccagttttcgtctcagccaaatttcgagtttgcacgggaaatcaaccaacgtctcgaccggcttcaggtttcggcgaacggggataaggcaggcgtcaaggagatcgttcgcagtgggaggattatcctgactctactgccgcgattgaaagacaccgttggagtgatccaaacttctgaaaccatcgacaacacgaagaagttgcagcgagcataccttgaagcttatagcttggccagcgcgggtgaacagcgggtacgggtcttcctcggcgcagtttcggttttcttttgcttttgcataatttccctagtccataggttacatctgcgaaccaaggtgttgacgagacgactggacttcgaagaagtgatcaaaaagattgggctttgcttcgaagatgcttcagaagcaaaaccgtcgttggaatcctcaacgaatgccgcgttgggaattatccaattattctttgaagctcatcaatgcgcgctgggactggtcaacatcaatgagaatgacgttagcgtcaccttttttggaagcactcctgcgccagagtggaacgaacaacgggtgcgcgaaattgtttccacggtaggggccgaggacggcgggcggattttccgagcctatcctcaacgaaaagcgagctgcttcggtgaggactctccatttctgtgggtgctgcttgcgttcaaggtatccgatcgaatagtcgctgtctttggcctgggatttgatcgagagcatctacagacgccgaccgcacgtgaaatgcagctgatggaactagcggctgcatgtgttagccactatgcggtcattcggcgcaagcagtcccagcgagatattctggaacgtcgtttgaaacatgcggaacggcttgaagcagttggtacgcttgccggcggcattgcgcatgaatttaacaacattttgggtgcagttctgggttacgcggaaatggcacacaacgttctgcgccgtcgtactcatgctcgagactacatcgatcacatcatttctgaaggcaatcgagcgcggttgattgtcaaccagatccttgcccttagtcgaaagcgggatcgaacaacaaaaccattcgatctttcggagttagtgaccgtgatcgcgccgtcgttacgtgttgcgttgcctccgggcgtcgagctcgatttcaaatatcagagcgctccaatggttatcgaaggaaactcacttgaggtcgagcaaatactgatgaatttgtgcaaaaactctgctgaagcatgccgagagttagggcgtgtggaggtcagcgttaggaggtctgtcgtacggaaacacaaggttcttacaaacggtactattcccaccggcgagtatatccttctttcagttgaggataacggcgcaggcataacagaggcggtattatcgcacattttcgagcctttttttactacccgcgcccgcagcggtggcacgggcctgggattatccacggttcacggtcacgttagcgcgatggctggttacatcgacgtggtatcaactgtcggcagaggtacgcgcttcgacgtctacttgccaccttcgtcgaagcagccggtaaattcagagagtttttttgaccctggaagaatcccgcttgggaacggcgagattgtcgcggtggtcgaacccgacttagccacgctggaaatgtacgaggaaaagatcgcggcgctgggctatgagccagtcggctttaacacgttggatggtttaatcgactgggtgttggaaggaaaagaacctgatcttgttctaattgatcaaccgtctttgctggatggagacggtgcagggtccttaatctcaaagctggcaaaagcgcccatcatcattattggcgaaaaccagaaaaatgttcccctttctgcggatcgcgagggatctgcccgttttttggaaaagccgatttcagcaaagactctcgcctatgtcgttcgtgcgaatatcagaactgaacgaatggtcggctcgaatagcagcgaaatcgtgattgcgtcataaaccgatacgccctctgaacagaagccggccgcacaacgcgattgcttattaatttaatccccagtcgcggaatcagccggtcagtcccgacatccgcaacaacgcaactccggttgcggctgcaatcaccgccagtgatatacaggcaaaaaaccggtaaacctgctcttttgatgttaagaggagatggatcgaagcgatcatcagaaggaaaatcgtcgcaagtgcgccatacgcccaatactcgttcgaataaagccatgttcccaaagccaacagaccgcaaacaaaaaaaacgagttcgagcttttgcaagacaacacctcaaaaagatctcgttgtgatcctaggacatcggtctcgcaggtcaatactgcgatcgcgtttcatgcaacggacttgatgtatctgccgcgcggcactaggagacgtgaggaacggccccctgtctagggtgcagtcggtgccgatctccgcttcgggggcgctttgcgaaatctcctgcggctgcaccatcctccgcgccagcctgcgaaaattttcgaaaaccgccgctatggtgaattcgctctcatggcctagggatcaccgcttgggccgccgattccctcgattcaagaaatcaaacggcttcgcttcgatgcttcaaatgaaaccgagaggtaagataataaaatcagaaagtaacagacacctcccatagtcgcgactgttagcgatcgagtcatttcatgctgaccaagatcattgcgatacagtggggaataaacaatgcggaagacggcaggatctttcgggatcatttttctgatggtccagccaagcaaagctgcgccgctctcgttcgctgaatttaaccaactcgctcgcgaatgcgcaccttcagtcgctccatcgacgcttggagcgattgcgaaggttgaaagtcagtttgatccgctcgtgctgcatgacaataccaccggcgaaactttacatggcaagaatccggcggatgctacgcaaagcgtaaacaatcgcgtcgcagcagggcattcagtcgatgtaggcctaatgcaagtgaactcgaaaaatttcgcgaacttgggcttgactgccggcaatgcaatcaacccttgcgtgtccctgtcggcggcggcggacctgctcgtacggcattatagtggcggcgacacggtagagtcagaacaacttgccatccggcgagcaatttcggcttacaataccggcaacccgacacgcggcttcgcgaacggctatgtgcggagggtcgaagtggcggctcagctactcgtccccccgctggctcagtcggggaaaaaaggcgaccgtgatgagcggagtccagaagaaccctggaacgtctggggttcatacgaccgctcccactcagcagtcggttcgtccgcgccgccagaggcgcagcagccgaatgagcgcaaatcccccgaacaagatcaagttttcgaaccgaatgatggagatgcaccataatggcatggcttgaaggataccgcgcaccgtcgaaattccgtggcctctggcacagagctgtgcgcctgctggctccgcacgtgccgagcgtcaccggcgcgatcggctggagcttgtttttctgcgagccagctgccgcgcaggccgctgggggcactgaccccgccaccatggtcaacaatatctgcacgtttattctcggtccgtttggtcaatcgctcgccgttcttggtatcgtagccatcggggtatcgtggatgttcggccgagcttcccttggtctggtagcaggtgttgttggcgggatcgttatcatgtttggagccagctttctcggccaaacactgacagggggcgggggatgaatgccgatcttgaagaagccacactctacttggcggcaacgagacctgcattgttctttggggtaccgctgacgcttgctggagttttcatgatgttggcggggtttctcatcgttgttgtgcagaaccccctctatgaaattgttctcttgccgctgtggcttggagcgcggctcatcgtagagcgggactataacgcggcaagcgtggtcttgctgtttctccagacggcagggagaagcgttgacggccatgcgtggggcggcgcgagcgtcagtcccaaccccatcagagtggcgtcgcgaggaagaggaatgacgtaatgttcggagcaagcggacggaccgagagatctggggaaatctacctgccttacgtagggcacctcagcgaccatgtcgttcttctagaggacggttccatcttgaccatggcgcatatcagtggccttcccttcgaactggaggaagtagaggtccgaaatgcgcgctgccgtgcctttaacacgctctttcgcaatattgccgatgataacgtctcagtatatgcccatctcgtccgtcacaacgatgtgccagtaccgccggtacgccattttcgcagcaccttcgcgtcaagcctaagcgaaacgttcgagcggcgtgttctgtctggtaaactgtttcgaaacgaccacttcctcacgctcattgtctctcctcgcaccactctcggtaaagtgggaagcagattcaccaggcgctatgggaagaacccaggcgatcttgcgcatcagatccgacatctggaggatctttggaacgttgtcgctggcgcgcttgatgggtatggacttcgtcgacttggcatccgagaaaaaaatcaggtgcttttcacggaaattggtgaagcccttcgcctgataatgacttgtcgttttttaccggtgccggtcgttagcggatccctcggcgcctcagtttataccgaccgggtcatctgcggcaagcgtgccctcgagattagagcgccgaaagatcgttacgttggatctatcttttcattccgcgagtacccggcaaagacgcggcccggaatgcttaacacactcctgtcatcaagttttccgctcgttttgagccagagtttctctttcctcacacgtgcacaggctcacgccaagctcagcctcaaatcgaaccagatgactagctccggtgacaaggcggtcacccagatcggtgaactcgcccaagcagaagattcattggccagtagcgaattcgtcatgggttcgcatcatctcagcctttgtgtctatggcgatgatctcgatacccttgccgactatggtgcgcgagcccgcacgagcttgtcggacgcgggcgcggttatcgtgcaggaaagcattggaatggaggctgcatactggtctcagcttccaggaaaccacagatggcgtacccgtcccggagcgatcacttcacgcaactttgccggcttggtttcattcgagaacttccctatcggaaggaagtcgggccattggggaggtgcggttgctcgtttccgtacaaacggcgggacgcccttcgattatattccgcacgaaaacgacgtgggcatgaccgcgatcttcgggccgattggcaggggaaaaacgacacttatgaccttcatcctggcgatgcttgagcagagcgtggttgaccgcagcgggacgatcgtttttttcgataaggatcgtggcggtgaactgcttgtgcgcgccaccgggggcacgtacctcacgttacgacgaggtgtcccaagcggccttgcacctttgcgcggcctagaggatacggcagcggcgcgggactttctccgcgagtggatcgtggcgctgattgaaagcgacggcagggggggaatttcgccggaggaaaatcgccgcttagagcgcggtatccaacggcaactttcgtttgagcctaacatgagatcccttgcgggcttaagggagttcttattgcacgggccctccgaaggtgcgggagctagattgcagcggtggtgccgaggcaacgctcttggctgggcgtttgacggcgaatcggacgaagtgaagttagatccttcgattacgggcttcgatatgacccatctcctcgaatatgaggaggtatgcgcgccggccgcagcataccttttgcatcgaataggagcgatggtagatggccgacgcttcgtcatgagctgcgatgagtttcgttcctacctgcttaatcagaaattcgcagcagtcgtcgacaagttcctgctgaccgtccggaagaacaacggaatgttagttcttgcgacgcagcaacccgagcacgtacttgattcaccattgggcgcaagcctcgtagcacaatgtatgaccaaaatcttctacccatcacccactgcagaccgctctgcttacatagacgggttgaagtgcaccgagcgagaatttcaggctattcgcgaggagatggcgattggcagccgcaaatttctgctgaagcgcgagagcggaagtgttgtgtgcgaattcgatctgcgcgacatgccggaatacgtcgccgtactatccgggcgtgccaatacggtgcgttttgcccagcagttgcgcgagacgcatggagaggaaccctctgcctggctggaaaaattcatgacgcgctaccatgaggcacaggattgatctggagttcgaagtcatgaatattacgaagctcgtaataaacgcacttttcatatgccttgttctgtcggggactgccaaggcgcagtttgttgtcagcgaccctgcaacggaggccgaaacgctgacgacagcgatcaatactgcggcgaacctcgagcaattgatcacgatggtgacaatgttgacctcgccctttggcgtcaccggcatgttatcagcgatcgaccagaaaaaccaatatccctctgccggccaactcgacaaggaaatgttttcgccgcagatgcctgcttcgacaactgcgcgtgcaattaccttagatgccgatcgcgcagtcgtgggcgacgacgctgaaggaaatcttttgcgacagcagattgcaggcgccgcaaatgctgccggtgtcgcggctgacaatctggatgcaatggacaagcgccttgcggcaaattctgagacatcgggccagctctcccgctcacgcaatatcatgcaggccaccgtcaccaacggtttgcttctcaaacagatccatgacgcaattattcaaaacattcaggcgaccagcctgttgacgatgaccaccgcacaggcggggctgcacgaggcggaggaggcggcgacccaacgaaaggaacatcaggcaactgcgcttatatttggcgccgctcaactgcactgatccgctactgttcattcagggccctctttctccgtagaaaatcgaagctaaatccaggtaagggcaatgaattttagcattcctgcgccttttacggcgatacatacgatattcgacctcgccttcaccgtcgggctggacacgttgcttggggacattcaacgggcagtcagcgctcctctcgtggcctgcgtgacgctatggatcattgtccagggcatcctcgtaatgcgtggggaaatggacgcacggggcggaatcacccgggtaatcatggtatcggtagttgttgctcttatcgttgagcaggcggaatatcatgattacgttgtctcggttttcgaggatacgattccgaatttcattcaacagttcggtatcagtgggcttcctttgcagacgattcctgctcagctcgacacgatgttttcactcacgcaagtagcctttcagaagattgcttctgaaattgggccgatgaacgatcaagacatcctcgcctttcaaggcgcacaatggattttctatggaacgctttggactgcgtttggaatctacgatgccgtcggaatcctcaccaaggtgctattggcgatcggtccattgatgctcgttggctatctcttcgatcgcactagagacatggccgcgaaatggatcggccagctcgtcacttatggcatacttctgcttcttctaaacatagtggcaactatcgtggttctgacggaagcgacggcactcgtgctaatgctcggggttatcacttctgctggcacaacggcggccaagataataggcctctatgaactcgacatgttctttctgaccggcgacgccttgatcgtcgctcttccggcaatcgccgggaatattggagggagctattggagcggtgcgacgcaaacggccggtagcttaaatcgccatttcgcccggacaatccgccgttagtcccagcttcacaaatggaggatttccttgaagtactttctattgtttttgatcatcggcttggcgtcttgtcagacaagcgatcagttggcgacttgtaaggggcctatttttccgctgaacgtcgggcgatggcagcctgctcagtcggaccttcagcctaccaacgcaggagaggctaatgaacggctctgaatacgcgctgttagtagagcgggaagcattggcggaccactataaggaagtagaagcatttcagtctgcacgtgctagatcagctcggcgaatctctagagccttggctgctttggctgtcattgcagtcgcaggaaacgtggcgcaggccttcgctatcgccgtcatgcttccgctgaacaaacttgttccagtatatctgtgggtgcgcccagacggtacagttgacagtgaggtatctatttcgcggttgccggcgacgcaggagcaagcggtcgtgaatgcgtctctatgggagtatgttcgtctgcgggagagctactcggcggatacagcccaatacgcctatgatctggtctcgagcttcagtgccccaacggtgcgtcaagattatcagcagttcttcaattaccccagtcctagctccccccaaaccatcattggtaagcgcggaaagctggaagccgagcacatcggctcaaacgaacttatgactggcgtccagcagatccgctacaaacgcactctcatcatggaagggcaagctccaatagtaaccacctggaccgcaacggtacattatgaaacggtaactaacttgcccggccgattgaggctgacaaatccaggcggcttaatcgttacctcctatcaaacttcggaagataccgtttcgaacacgacgcggagccagcaatgatcaagaatttgtttctgggcctggtttgtatcctctttgtaaccagcggcgcgaacgcggaagacacgccagcggcaggcaaactggatccacgtatgcgctatctcgcctacaatcccgatgaggttgtgcacctttcaaccgctgttggagccacattggtcgtaacatttgggtccaatgaagcggtgacagccgtcgccgtttccaacagcaaagatctcgctgcgctcccacgcggcaattatctgtttttcaaggccagcaaagtgctgcagccgcagcctgtgatcgtccttaccgcaagcgacgcaggaatgcggcgctatgttttcagcctcgcgaccagaacgatgtctcggctcgataaagagcagcctgacctctactacagcgtacagttcacttatcctgccgacgttgccgctgctcgccgaaaagaagcggagcagagagatcttgcggatcggatgcgggcgcaagcacaatatcagcgtcgagccgaggacttgctcgagcgtccgccagcaggtggcagcacagatgcgaaaaattggagctatgtcgcgcaaggagaccgctcgctattaccgctcgaggttttcgacaacgggtattccacgacatttcgctttcccggaaacgtgcgtgtaccttcaatctacgtgattaacccagatggcaaggaagccacggccaactattcagttaagggagattacgttgaagtagcatcagtttccagggaatggcgtctgcgggacggccatacagtactttgcatctggaataaggcatatgacgccgtcggacggaagccgggcactggcacagtcagacccgatgtagtgcgcgtgctgaaggagacgaggtgatggaggacgtgaatgcccaatccagagaaggtatcgacgcgcccggatccctcgtcaccgatcctcatggccggcgcctctcggggtcgcaaaagctccttgttgcgggtttagtcctggtactgtcgttgagcctcatttggctcggggcgcgttcaaagaaaaggaccgagccgtctccaccaaacacaatgatcgatgccaacacgaagccctttcggccggccccgattgatattcccgccaaaccggcaatgacaccgccagctgcggaagcaacggttttgccgtcggatcaacatcagcgagaacacaacgaactgaggcccgaagaaacaccgatctttgcctacagcggaggtgatcagaatggtgtcaaatccgccccacacgctgatattcagaacggtggccaagacaatagaaacgccaactccctagccgcgtcggaggattctgctgagaacgatctctctgtgcgcttgaaaccgacagtgttgcagcctagcctcgctatacttttgccgcacccagatttcactgttacgcaaggaacgatcattccctgcatactgcaaaccgccattgatacaaatctggcagggtatgtgaaatgtgtacttcctcaagacatacgcggagcaaccggaaatgttgtgcttctggatcgcggaacgacagttgtcggcgaaatccagcgtggactgcagcagggagacgcccgcgttttcgttctctggaatcgcgcggagacgccctcacacgccgtcgtctctctttcctccccgggggccgacgaactcggccgttccggactgccgggtacggtcgacaatcatttctggaaacgctttagcggggccatgctcctgagtgtcgtccagggcgcagtccaggcggcaagtagctacgcagggaattcgaccggcgggaccagcttcaatagtttccaaaacaatggcgaacaagcggccgatacggccctaagggcggccataaacattcccccaaccttgaaaaaaaatcagggtgacacggtctcgatcttcgtcgcgcgggatttggatttctcaggaatctaccagcttcatatgactggtggatcggtgaaacgtcggcatctgcgctaatgcacagatagccaaagctgcgagatgcatccaatggaagtaaatccgcaattgcgcgcccttcttaacccagtcttgcaatggctcgatgacccgaggactgaagaagttgccataaacggaccgggagaagcctttgtacgccaaagtggcgtcttcacgaggttcgccgcaccgttctcttatgatgatctcgaagacatcgccattctagcaggggcattgcgaaaacaagatgtcggcccccgcaaccctctttgcgctaccgagctcccaggtggcgagcggatgcaaatctgcttgccgccaacggtaccctctggcaccgtgagcttgacaattcgacgaccgagcaatcgtgtctctgaattgggggaagtctcggctcgctacgatgttcgtcgatggaatcagtggcaaatccggacgcagcgacgagatcaactagacgaagcgattctgcgcgactacgacaatggcgatctggaatcatttttacgtgcatgtgttatcggtaagcggacgatgttgctttgtgggccgaccggaagcggcaagaccacgatgagcaagaccttgatcagtgctattccgcgggaagaaaggctgataaccattgaagatacgctcgaactcgtcattccacatgagaaccacgtcagactgctctactccaagagtggggcagggctaggtgcagtgactgcggaacagctgctccaggcaagccttcggatgcggcctgaccgaatattgctcggtgagatgcgcgacgacgcggcgtgggcgtacctgagtgaggtggtctcaggccaccccggatcgatttcaaccatacatggggcgaatcccgtccaaggcttcaaaaagctgttctcacttgtgaagagcagtgtgcagggggcatgcttggaagatcgcacactgattgacatgttggcaacggcaatcgatgtcattgttcccttccgtgcttacggcgatgtttacgaagtgggcgaagtatggctcgccgccgatgcccgccgacgcggtgagacgataggggatcttctaaaccagcaatagagccgcacggaggtctgctcgcgcagattttaaagcgttacaagtgtagcgcgctgcagcaactcctgtcatcaatctgaaaccttccgttagcatttttgtcatgcacggcttggccgaaattttgccgaactaccctcatagtgagagaaaatgatcaggttgaggctgagacgtacatcctctgcttgcacgaatctatcgattctgcagaatcccatacggaggcgaactggtgaaacatgttcttgtcatcgatgacgatgccgcgatgcgccatcttattaccgagtatttaacgattcatgccttaagggtcaccgcggtatcagatagccagcaattcaaccgggtacttgcatcagagacggtcgatgtcgtcgtcgtggatctcaatttagggcgtgaagacggacttgagatcgttcgcagtctcgccacaaaatccgatgttccaattataatcatcagcggtgatcgccttgaggaggcggataaagtggtggcgctcgagctgggagcaacggattttatcgcgaaacctttcggaacgcgcgagttcctagcacgcatccgtgtcgcattacgcgtgcgaccgaatgtcatgcgaaccaaagaccggcgttcattttgtttcgccggctggacacttagtctcagacagcggcgattggtatccgcacaaaatggcgaggtgaagcttacggcaggggaattcaatctgctcgtcgctttcctggaaaagccacgcgacgtgctttcccgagaacagctcctcatcgcgagccgagtgcgtgaggaggaagtatatgacagaagcattgatgttctcattttgaggctccgccgaaagcttgagcaggatgcagcgagcccaaacttgatcaaaactgccaggggtgccggctatttcttcgacgctgatgtggatgtttcctatggaggtctgatggcggcctgaagcagcgacgcatatgcctttttcgatctgatcctaggacgcggactcgttaattgaagcgatccagattctcgtcgcggcaagtttgagcccggcaaggtagttgtcagcacgtctgtcgtatcgtgttgccagaccacgcatctgtttgatggttgaagaaacgctcgatcagattgcgctggcgatagacccaacggctgaaactgaaggtctgttttcggttggccttggcggggatgtttgcccagcatttgcgttgcttggcgaagttacggatcgcgtcggtgtcataggccttgtcggcaagcagtgtcgttccgggccgaatgtcactcagcagcttttcggccataggagcatcggcggcctgaccggcggtcaatgccagtcgaaccggcaaaccatcagcatcgacgagcgcgtggatctttgtcgtcaggccgccacgcgaacgtcccatgcaaggatcggcagatccccctttttttcgtttgcaccatgctggtgaacgcggacgcaggaagaatcgatcatgacgatctctccggcataatgccttgaaacagcgccgggaaggcgatcccagacgcctgccttgcgccagcgagagaagcgattgtagagcgtcgtgcgcggaccatagcgctccggtacatcacgccaggatgaacctgtccggaaacgccataggataccattgatcacccggcggtcatccacgcgctcaactccacggctgttggtcggcagcaaaggggcgataaccgcccattcctcgtcggtcagttcgtgacggcgcataacaatctcctttccaggaaattgaatcacacaacgtcatcaacatgaaccccgttatggggacacagcctagagtgagctggctgtgttgtagctgggtaggggctgcctcattgcctgctgtcgaatacaataccgccgtcaagtgaccggcctcatcatattagcgttcttttcttatcttctcttcggcaaagaaagatgcaagtgcggccgtagccagtttgtggccaaaagccctggcggtctccaatctcaatggatcaaagtgattgcgtgcgacttctaacagcgataccgggaacatgcgagaagtcaggacaacgataggtttttcgactacttttgagatcgggtagctttgaggccccgtgctaaatgatccgtccgccaacatgttctcaaaatcggcgagcgcacggcgcaagatcatctgcagcgccttggtagcgctgtactgcagaatcaagttgtcatatatcttcgatacctcaggagcgggggggcgtgccgaaagaaagacctggactttttccggcggcgcagtcgaactcaaggcgtccgccgttagcattgattgccgatcgaagttgtcacgacgtttggcggcgataggaggcgctggtcgtttttcctttccggctctttcaggtaattgcgaaggcgccaagttttgcgaggaaagagctgggattgggtgaacgatcggtcgcgcggcagcaagccgtcttgcttcaccgacagacaaagcaggtttgcggatccccatcttcaattccccaaggtatcgccaatcaattctgaaattgttacgagttcctccatcgcaattctgaggttccgctcaaggaggcgcatcgtcggatcatttgtcgtgttcagcaatgtgagatgcaacatgccacgctctttcattgcagcgaacgcgtctcgttcatgcattggagattgtacgacaggcagattcaccagcatgtctgacatcgcgcgttgtgacgtggttaatcggccaaccggaactcgctggcgtaacacggcggtcggaatcactaagttctcgctcagcagcagctcgacaacataacgatatgtcgaaagtgcctcatcgatatccagcggcgttaacattgtcgggatcagaagcaggtttgagctagcgatgattgtgttattgagctcgctcgaaccaccatgcgtatcggccagcgcataatcaaattcctgaagctcggcgtcctcataagccgcttcaagaagcgacatttcttctgcagcgtacacctcgcaggatgtatcccaggtgttgctacgcatcgcgttttctttccatcgcgttaacggccggttctcgtccgcatcgaagagagccactcttttgccgtctcttgcaaacgcagcgcaaaggcccatgagcgccgtggttttgccggcgcctcctttaaatgagcaaaatgtcagaagtttcataagtttatcctggcgacgttgtgaacgaaagtgcgtctgtatcattgtttgtatgtgtgactgtctgtatagcgaaattatcaggagtatatttcaattgcattgaaggatagttgcaaatgtaactatatagatccgaatatgaacagtatattcttgaatttattctgttggcggctaggctccctcagtctcaactggagaatttcactccggaacaaatccagatcattccgttttctatggagcaagccatgtcgcaaagcgaaaaatccacttcaagtgacattgtcgaccggcgtgaaggcccgaagattgaaggtttcaaggtcgttagcactcgtttgcgatcgtcggaatatgagagcttctctcgccaagcccgtctgctggggctctccgacagcatggccataagagttgcggttcgccgcattgccggctttctcgaaatcgatgcagagactcgtcagatgatggaagccattcttcattcaataggagcactctcaaacaacattgccgcgctgctgtgtgcctatgctgaaaatccgacaacggatttgggcgctctgcaagctgaacgaaacgctttcggtaaatcgttcgctgatctcgacggtttgctccgttccattttgtccgtatcacggcgacggatcgacggttgctccatgctggcggacgccttgcagcattaacgtagcacttgggggaatctgttggatgcccgatcggtctcaagtcatcatccgcattgtgccgggaggtgggacgaagaccctccaacagattatcaaccagttggagtatctatctcggaagggcaagttggagctgcagcgttcggcccgacatctcgatactttcgtaccaccggatgaaatccgcgaactcgccctaagctgggttcaagaaaccgggacttatcacgaaagtcggccagacgaggaaaggcaacaggagttgacgacccacattattgtaagcttccctgccggtacaagtcaggtagcagcttatgcagcgagccgggagtgggcagccgagatgtttgggtcaggcgcagggggaggccgatacaactatcttacagcctttcacatcgatcgcgatcacccacatctgcatgtggtcgttaatcgtcgcgaacttttggggcacggctggctgaaaatatcccggcgccacccccaactgaattatgacgccttgcgcattacaatggccgagatttcacttcgtcatggcgtcgtcctcgaggcgacgagccgagctgagcgcggcatctcggagcggccgatgacttttgcccagtatcgacgcctggagcggcagcaggccaatcaaattcgtttcgaggatattgatttcgaagaattctcgcctgggggaaacgacggagaaccggatcaatcttttaattcttcgtacggttcgctgcctcaaaacgtgtcagaaaacttgcgacgaaacggcggtctgcaatcggtgtctgaagtacgttcccgggcactgatcggatcgaacggcaacggtgtcacgcccgatcgtgtatcatctggaaacgattcccgttctcaatccggcagcgataaagcctttgtggacgatggcaacttgaggaacggccctctcaccatcgccggagacggccaggatcttgaaggccgttctggcatgcatcgtttggcaaccgaacccgtcacgcacacaacaagcgaagatgatgttcggcaacggcctcatcgaaaacggcctcgcggtgatgaggaagagcagagcggcgcaaaactgaccagggtagacggaattcggacgggagtgacaatcagcgccgtaccggttgcccaggacgatccgattacatcgccgatccagccccctggatcaaatccgttggatgacccggggcagaccaacatcgctacggacgcattgcctccgacagccgatcgccggcagcagggagagccaaattctaagcgtcctcgtgatgatgacgccgagccgagcattcgtaagcggtcaagggacgggcgcagccaaggggatgagggaaacagaaggtagaaaaggatcgatcatggcagatgaagaatttcgtcgagacttcagccgctccgctacgttgaactcgaataacgaaggcgctacaggcgcaccaatcccggatacatcggtgtcgactgccttccgacaaaaccgcagagaacacttaacgaccagttccttacggccattaattactggtggggccggcgaccttccaggcacttcccccgaaaatcaacggccgacaacccatgccccgaatacagcagaaatactcccggtgagatcagccgaagctccggctggccaatcagcggtctttccgaggagcaaggggtattttcgtacggccatgcaatacctgcgggagattgaaatgcagtccactgccagggcggaccacgaggcgacgtcgtcgtcacgttttggcaagggggaaagaaagcagctgcgcgaacacgagcaaaccggtgatcaaagtgaatcaatggcgaagcggagtaccagctcgggaatgcaggtgggaactattgccgcgtctttggctatgaaagatagctcgaccgcgacgccggcttcgcaagggccgcaccggtctgggatggagctggataatatcgaagggactggagagagccgtacgcaatctcagcacgaaattgcgacacaacctattgccacaagcgcttttggttcaggtcatgatgtgatcattcctggagagggccagcctgaagaaacattcgacggcgcaccatattggatggtagaaagcggggatagcgagaccaatagccttccgtcgatccaacaaggcttatcttggccagggttagatgaccttgatttgctcgccgacagcagttcaccgctcagtactcaggttgttcctcctgacgtagccgctacgaatttaagcactgaggcagggtccgccagcgtcgaaagcacccaaatcctcgccgacagtgcctattccgacgacgcgaccgaaaccggtggccaaacagcttcaggatcgatccatgaaggctcagttcgttcgcttggctcaccggaggaacgcttcgacgcctttcccgagttgaccgacgaggacttggcgcagattgacgcattctcgcgagcccgctctccttcgaggcgagatgctgcgcacgctattcatgcggtcagcttggatgatgccttctcacgcaaggatcttgccgcgggccacgacggccggcttacgaatcctgcgttccgtcaggaggcttctctgcaggaatcgagcccatcagaaacgaagtccgacgacttcccggaattaaccgacgaggacctggcacggatcgacgcactctccgaagcccgctcaacttcgaggctggatgttgcacgcactattcatgcggtcaggttggaggcctctcggcaggacccgagcccatcagaaatgaagtccgacgacttccccgaattgaccaaagaggacttagcccggatcgacgcactctctggaccccgcccgactacggggcgggaaggtgcgaacactattcagccagtcaggttggacgatgctttctcagccgaagattataccgtgggccgcggcggccggcatacgaatcctgcgttccatgaggaagcttctcggcaggacccgagcccatcagagatgaagttcgatggcttgccggagttgaccgacgaggatctggtaaggattgacgcaatctctgaaccgcgctcgaagagatctcgctccgagcaggttgtcgggggaaaatctcataggctcaaactgaacgaggctatcgaggaggcgggctcgcccactaccgtttcgggaacaagcgccgccagggcggcacctatcacgctcgaaagcggagtacctaggttgccgcaggctacccatacggaacttcctggctcggacgttgcgggtccactgcggatcgggaaggcgtcgtgtgccgatatacggcgagatgtttcggataaagggaaacgaaaagtctcgtcagattatcagattcagcaaggtcctggcgcgtcctatgcttaccagccgcgacgcatgccgacggaagcgattttcgatgctgaacggcttggtgacgaagtgctcatcgggaatgagccagttccgcggtggccttacccctgggagcacgttgttcgttttgaaacaggcaagcagctcttcgaaagattgcagaagtggccgactgcggaggagttggaaaacagtgtgatcctcgtcaaagcggatagcgcgcaacgatcctatatgccccgaaatcagctgctcttgcatctcggatccgaaaagtattacgaacgaatgaaagcgctcggtctatccgataataccttcagcggattgaagtccgatagcaaatatttttatgatacacctgctggaccacgggtaagtgaacatgattatgagttcccgcggcaggcaggcgtgcataatccagaggtgatggttcagcatcatagcggaaccttcttcgcgttttggccaaaacttctcaggctggaaaagcttgcgacagtaacgaatacgtatggcgcggaaaatgtttggctcaaatcgccagccaatgcttacatgacgccggaaacctataattccaaggttgcgaacggcgccgaaaaccttttcatcgagttcctacgtcccgctcctgtccacgaccacctgcgggaacctggaacttcaaacgcaaaaactgttgacggacgaaacgaagatcgcgcgcaacaggccgaccggttagcagatcagtcgatgggccggaacggggacggccgtgacgcgcagggtggtaagagaaccttggaaccgcgcgtgcgcgaaaggtatgggctgtagatccagctgcccgtaaagcaaacagccgtccaataggataaacggagcgtggtcacgtgatgaattcaggcaagtacacgccaataggcctggctgcgagcatagcatgttcattggccgtggggttttgtgcggccagtctctatgtcacatttcgccatggctttacgggcgaaacgatgatgactttcaacgtttttgcgttcctgtacgagacaccgccttatttgggatacgcaagtcctacgttctatcgcggactagccatcatcgttgcgacgtcaacgctcgtgttgctatgccaactactgttatcgatgcgcgagcgcgaacatcacggcactgctcgctgggccggctccggcgagatgcggcacgccaggtacctccggcgctacagtcacgtcacgggtcccatcttcggcaagacatgtggaccacgttggtttggcagctacctaagtaacggagaacaacctcacagccttgttgtcgcgccaactcgcgctggtaagggtgtcggcgtcgttatcccgacgttgctaaccttcaagggctcagtaattgccttggatgtgaaaggcgagctatttgaactcacatcgagggcgcgtaaatcaagtggcgacgcggttttcaagttctcgcccttagatccagagcggcgaacgcattgttacaatcccgtgctggatattgccgcgttgccgcccgaacggcgctttacagaaacgcgccgcctcgctgcgaatctcatcacagccaaaggcaagggagccgaaggtttcatcgacggggcacgggatcttttcgtagcaggcatattgagttgcattgagcgcggcacaccaacgatcggtgccgtttacgatctgtttgctcagccgggtgaaaagtacaaactatttgcgcaactcgcggaggaaacacaaaacaaagaggctcagcgtatcttcgacaatatggcggggaatgacaccaaaatcctgacatcctacacatcggtgctcggcgacggcggactcaatctttgggccgatccactcgttaaagcggctacaagcacctcggatttttccgtctacgatctgcggcggaagaggacttgtatttatctttgtgtcagcccgaacgatctcgaagtcatagcgcccttgatgcgtcttctcttccagcaggttgtatcaatcctgcagcgatcgctgccacttggagatgaacggcacgaagttctgtttctcctcgatgagttcaagcacttgggcaagctggaagctgtggagacggcaattacgacgatcgccggctacaagggccgcttcatgtttattattcagagtctttcggctttgacaggaacttatgatgaagctggtaagcaaaattttctcagcaatacgggtgtgcaggtattcatggcgactgctgatgacgagacgcccaactacatttccaaagctatcggcgactacacattccaggctcgctcaacgtcgtacagccaagcgcgcatgtttgatcataacatccaaatctccgaccaaggagcaccgcttttgcgcgccgaacaagtccgcctactcgacgacgattatgaaatagtccttatcaaaggccaacctcccctcaaactgagaaaagtgcgatattattcggatttcatattgaagcgaattttcgaaagccaacacggttcccttcccgagcccgcatctttgatgttgccgggagacacaaacctcgttgaaggcaagctcgaccagggaacagccgatacaacttcgcaaaaaccggtgcagattgaagagaacgaccatggggaagtcgtttccccccaaaacagaactgtggctgatggagtaatgccaatagaagttcgcccccgttcaaacgaagttgatgacgagcgggaataccaaggcgcggacgccgcaacctctgagaagcttccggaaattgctccggctcttttggcgcagcgcgaactcctcgaccagatcatttcgctccagctacgaggtagaacagcctccggcacttgaagctcgatgtgataccgcttcggatcgagtcttgttagcgccgtcagatgtcccgtttcgggaatgcattaccaacgttgaaggttgccaattgatgagacatcgccatgaaaccgtcgggaagctcaaaaactggatacgccgggtcggctagatcctcgccccaggttcgcgcaggggttacgcctgtccttcatcccaaagagccttggaaccgttttgcttgctccccatctgacggccaaatggatcaccgggaaaatttatctgcgcaattcgcttacgatggaatgagactgggcgcagccgagcggtccgcgtacgagacatgggatagagcggaccggccgagttggaaagacctgatactgagcgctcgcctgaacgcgattgacagtttcgcttggaatgtcgatgtcggagaaagtacctcttcaacttttgtttatgatggtgttcctctggcggaaggggaacggcatgcctacgaggaatgggtggagccgggacagcccagttggcaacaactcgttgtgaacgcgcgtattgaagagctaaacacctctgctgcaattccgaatgagtgtagtccccttcaagaggaattccgatcggaggcgcctaagcgtaagcggacaagctccattggtcaaaagaacggtttccctgaaccattcgaatttgatgggatgagactcggctcgcctgagcgcgaagcatatgagaattggagtaaaccgcaaccgccatcctggaaagacctgatagttgacgcccgtcttgacgcaatcgacacctccacctggctcaacgaatcaaatgacacctcggtcttcgagtacgaaggcgtcccgcttggggagggggaacgcctagcatatgaaaaatggctcaagcccgcgcaaccaggatgggaagacctggttgtggacgcacgcgttgcggaattgcaccagtctgctccgacgtggtgcgaacaccaaccaggcaacgacgtttcttccaacgagtccgggcgcatctcgggcgtcccaattaacgccgagcaggtgtcgcgtgcgttcttcgtgtacgatggagtggcgctcggagcagccgagcgcgctgcgcatgatcgttggagcaggccggaccggcccacctgggaagatcttatcatagtcgcgcgccaagctgctatcgaaggcggtgccgtttcgaatgggatgatcgggaagacatcttcctcagtctttttatacgagggaatgttgcttggggatgcggagcgtcaggcgtacggacggtggaggcagctagcccagccgcggtggcaaaatctggtggtgaacgcgcgcctggcagagctcgacccggcggcctggattcccgatgaacatgatccgtctgaggatggcggggcgactggtcttctgtcgcaagcaagcacgaccaataagtcccgcctcagtttaggtgatcaaccggaagcgcgctcgcctagtctcgcacgtgagccagcacaacagccgactcacgtgcaaaacctgacgtgcgcacaattggaagcaagacgtgctctatatttcgggccctctgggagggatgcagaccaaaccgccagcatcgccgacagtaatcgcctcgacgaggtaagcaaagttaaacggctgggtgccaagagccgtcgaggcgctaaagcaacggcctatgacgtaatttcaagtgcggaaagactgtcgtctcacgagggttgtttgacggttcagtccactcagccagaaaaagccgcttgctcgagaagcgacaatatcggcacttatggaagtcgaaaaaacgaacgagctcggcttgcgaccgagaccgggaaatacgagtcggagcatattttcgggttcaaggttgtccacgataccctgcgctcgaccaaagagggccggcggctggaaaggcctatgcccgcctatctcgaatgcaaggaacttcatcgacaacatgttggtacgggaagggggcggacccgactggtggggcgcggctggccagatgacgcaagttaccgctcggatcaaagggcaactctatcggaccctgttgcgtccacggaaggtgcaacggcgtcaaacgggtatcaattaaaccagctaggctacgcacaccagctcgctaacgacgggctgcagagcgaaacgccagatggggttatcatgccgcttcaggtcgcgactactagctacaactatacggtaagccgcgatccggtactttctccgcccagtaaagagcaagctccggaattgttgcaccttgggccacgtggccagacagaagctgtactcgctcgcgaaacagcattgacaggaagatggccaacacgcgagcgtgagcagcaagtctatcgagagtttttagccctttatgacgtcaagaaggacctggaggccaagacacttgggttgcggaagaaaaaagctgcgcttgtttccgcgttgaaccggactgccgcctcaataggcacttcacccttgaaagcccaatcgtcgagcgcagaagttgaaaaagcaactcacgagtttgatgaacgacgggtttatgatccgcgcgatcgcggtcgggacaaagcattacaacggtgacaaagctggagatgaccatcgttagcggactttgtatcgatgcttaaaaatgatggttcagcatttgaaccgcaggctgtactgctactctttgaaatcccccgcaaaaaacgcgccgtagtgcaatcgatcgccagggcctgaatttcagttgaaacacgatgtccattcaacgccttaagcgcaggtgttagacttcgcatatccttgatccgcgttggagtgtgagttatgctcgaagacggccagaaaatgcaggaacgcgagctttcggtcctcggtggtgataagaccgaaagtgcagccaccttaccgaatgacattttggtggaagttgccaaacatctgccgaccgacgatccagtcgaaacggcagccaacctcacaagctttaaacttgcgagcccgtcggttcgggcatcggtcgatcagagcgatgtcggaacgttccaccgaagcgtaaatcgactgggtgcctcaagcaaggcattgtatgacctggctgtaccccggaacggctttgccgagtatccgaactatccggaaccggaccctgctggcgagtttgcgctggcgagccagcgcatcaggacaattggtccaactttgaagttccaatcgcccgccaggaaaacagcgatcgtcaatcacattctcaatatgtcggaaggcggtgagcaggcggaggcgattatgtcgatgacgtcccatttgagtgacctcgagagggccgacaagagacgccttatcgacagagcaattgaatacttcaaggtagacgggcctatcaactacgacagtcgccattatgcagcctacgcgattgcagcggcgcacaaccagttggaactcgaacacaagtcacaaatcttcgatgcaatggcgaagagaccccagcttgcgagactctacgccgacgaacgcatccatgcgcaggagcatttggggcttgcgtcgacatccgaaggtccgcacgagcggagcaataaacaactggccacggacattcttcagatcgaacaaaaaatccgcactgagctccttcccgaaactctcagtgctcacgaccagatggtaaaagcggaaggaatcgctggatcgattgagaaggcttaccgcgatgctcgcgcgaacttaacccgggcaccgcgagggaggtcaaattctgatctcagccggtagaacttggtctgaatattcgattatttctccgacgaaagcacttggttgacgagcgaatttttaaacgagcatcgataaagcgtgcacagggaaggcccacctaatggtcagtataaataaaaaagccccgcagaaatcttctacagcgaccacgcgcaattctgatgaacgcctggttgatcagttagggcaggcgtaccttgtggaacgcgaggcgcaggaaaggcgcgcgcgacttgaagcgccgccggcgttgaaaaaatatgcctcgaaactgcaactcctcaataagctcgatgcagatttccgtggtgtgatcgcccacaagccgtttcgcagcgagcaactgcgggtcgatagcaatggagaattgacccatagtcggggtctcataaaaaagaagaagaaggttttcattcgagatcaaacaactggctcccttcggcttattcactacgagaggtctgactggaatagtgtccgtcgctatgactacgaccagaacggcgtgttgagcgagaaacatatcaaaagcaaagccggtgccttcgaagaaaaatgggagcgggacgaaaacggtgaactgatgcgcacccgatacatcgatcggcgcagacttactggacgggcgttgcatcccatttccgaggaaatcggacgtccttatgagagtggcctggagaagaggctttatcgcgttttaacgcgtcgggagggctcccaacaaaagactttcgaacgcgatgacaagggtaatctggagctcattgcaagcaaacggatgggctattcgatgtcttcacaaaaggcaccggatcgacaaacatctagaacaagtatccgcaagcttggcggagctttcagtgaatcatatagatcccggctggataaggacggccacgagttaggtcgggatgtctccgcacatcgaagcctcctcaacaagcgttcagccgtctacgatgacgctacaggggagctaaagagcagcaagcacacgtttgggaagatatacaaagcggaagcgacatacctgaacgccgaaatcaaagaggtctccaaaaaaatcctcggagttacggtcggtaaagaattgaagacattaagtggacgcgaactcgaggctcaagtattacgtgccgcggaacgtgccctccataaacaggcctggcagcacccttcagctaacccctcgcggtcgcagcgggaaaataccaacagtcatcttggaaacgaacttgatgggccgctcgaatcggatatgaccgtcgtccatcaagccggatccgggttcgtcggcgacgatcgccacgttcatgatggcggtggatccaggttgaatgaattgcacgaatcgcgatcgtcgaatgatagggaaaagcttagttcgccgagagccgaaatttgcgaccgctcgatgaatcgggatcgcaccggctcaggtactttgtcgcgatgatagctaaactaggggggcacacaccgagttgtcaagtcgccccccggcaaatgagctcatccctgctgccatattcccaaactaccaacgtttcgcgtcaaaatgatcactgagaaatccgtgccatccccgaaaataactgccacgagtgtctcatcgaagcccacctgccgtgtcgtgcggcccggcagcacctatgccggaaaacagggtctcaattatttcgaagggattgcggccgagacagtgggctcgacggggatctgcatgcatcttttaaccataccgccgggcgcccgcgccaaggcgcatttgcacgcctcgcatgagacagcgatctatgcgatttccggagagacgcattgctggttcggcgaccagctggaagaacacgtcatcgttcgcgaagatgagatgttctatattccggctggcgttccgcatcttcccgccaatctcagcgaccggccggcgacagcggtcatcgcccgcaccgacccgaaggagcaggaaagcgtcgtcctgttgccggatttggaggggtatgtgccgcgttgaacgccacccggcggacccaacctggtgcaatgctacgagtcagtttactgtagggtaagcatccggtgaaggccgcaggttaggctgctttagctttcaatccgtgcggctgccaattccacggaagcaattgctcgagcttactgattggcgtgtcggcgatgcgggccaggaggtcagcaagccaagcctgcggatcgacgtcgttgagcttggcactttatgccgaccggcgaactatgcctattaatcaagttttttccaacgtttccggcagcatagcggtcgcccagtcggcatagcttagggtctctccgtcgcaattgacgcgaaggagaggacacatgaacacaactgactatttgaatcgcagcgccctatatcggaagctgctccacggtccgtatcgggagtttgcgcgtgtttacgccgccagcatgtcgaaagaaggcttgggtcggcaatgcacgtggcgctcgctgagcctgtttcgagacctgatggactggcatgttggcaatggatatgccccgcaggatttgagcgaagcttatgtcgatcgttttcttgagcatcgcttcaaacactggagtcccgatacgggcgaccgatcggcactccgacgcgtgctttcagcgttacgggaagagggcttaataccaggtgcgcttccggttgagcgcactgagcacgagcagatcgtcgatgtattcggggcatatctctcgaatgagagagggctcgccgcctcgacggtggggagctacaagcttctgtcacttcgatttctgcgggaggtctgtcctgccggcgcgaatgggtttgcagcgctcaccccggagattgtcatcgggtatgtcgaacgacatgcgctcgatggctccgccgacagcggcaaggcaatgtgcggagtcgtgcgtgccttactgcgctacttgcatttgaagggcttcatttcgacggcgttggccgattgcgtgccatccatccgccgctggcgacttgccggccttccaaccttcctgccgccagagaaggtccagaaggttctcgatgcctgtgaccggacgacggcaatgggacatcgggactatgcggttctgatgatcttggccaagctcggtttgcgcgctagcgaagttgctaccctcaatctcgatgatatcgactggcagtcgggcacgattctcgtacacggaaagggacggcggcaagcgactatgccgctgcgtcacgacgtcggaacagctatcgtggcttatatccggcatgggcgtcccgcttcggcgtgtcggcgagttttcttgcgaacacttgcgccgcacgtgggctttgcctccggctgcgccatcacgatgatcgcgaagcaggcactcgagcgggcaggcattgatggctatgcccatcacggcgcccatcttttccgccacagcctcgcgaccgaccttttacggtcgggtgccagctttgccgagatcggccaactgctccgtcatcgaagcatcgacagcacaaggatctatgccaagctcgatgttgacaagctgcgtggactgagcctgccctggccgggaggtgtccaatgagccggcttcgcactgccctcaaccgctatgtcggcatgcgccaagggctgggatacaaatatgatgggccggcacgacggttgtcggcattcgtcaccttcatggaagcccgcggcgccgagaccatcacgtcggacctggcaatgcagtgggtgacgtcgatgggccgacagccgagttggtccatccgcctggctgatgtgcgctgctttgcccagcacctcagtcatttcgatcttctgacggaagtgccaccgagcgacgcagtgccgccggcacggcggacaaagccctacatctatagcgacattgagattcaggcgctgctggcggcagcactgtcgctgccgccagccaacgcccttcgacgctggacgtatcactgcctgttcggactgatagcggtcgccggactgcgccattctgaagcgctcggcctgctccgggccgacgtcgatctcgagcagggcgtcctcactatccgagagacaaagttcggcaagtcacggctggtgccgct

SEQ ID NO: 107 - DNA, 20 bp, Artificial
  PCR Primer, oligoDNA
tacttcctcctcacgcactc

SEQ ID NO: 108 - DNA, 25 bp, Artificial
  PCR Primer, oligoDNA
gccagcaatgatcaagaatttgttt

SEQ ID NO: 109 - DNA, 22 bp, Artificial
  PCR Primer, oligoDNA
ttggtgcgacaactcctcggcg

SEQ ID NO: 110 - DNA, 22 bp, Artificial
  PCR Primer, oligoDNA
ggtgagctcgatcagcttcggc

SEQ ID NO: 111 - DNA, 1347 bp, Agrobacterium strain K599 (NCPPB 2659)
  CDS (1)..(1347): rcorf138, probable virD2, similar to riorf168 in pRi1724, the virA/G regulated T-DNA border endonuclease
atgcccgatcggtctcaagtcatcatccgcattgtgccgggaggtgggacgaagaccctccaacagattatcaaccagttggagtatctatctcggaagggcaagttggagctgcagcgttcggcccgacatctcgatactttcgtaccaccggatgaaatccgcgaactcgccctaagctgggttcaagaaaccgggacttatcacgaaagtcggccagacgaggaaaggcaacaggagttgacgacccacattattgtaagcttccctgccggtacaagtcaggtagcagcttatgcagcgagccgggagtgggcagccgagatgtttgggtcaggcgcagggggaggccgatacaactatcttacagcctttcacatcgatcgcgatcacccacatctgcatgtggtcgttaatcgtcgcgaacttttggggcacggctggctgaaaatatcccggcgccacccccaactgaattatgacgccttgcgcattacaatggccgagatttcacttcgtcatggcgtcgtcctcgaggcgacgagccgagctgagcgcggcatctcggagcggccgatgacttttgcccagtatcgacgcctggagcggcagcaggccaatcaaattcgtttcgaggatattgatttcgaagaattctcgcctgggggaaacgacggagaaccggatcaatcttttaattcttcgtacggttcgctgcctcaaaacgtgtcagaaaacttgcgacgaaacggcggtctgcaatcggtgtctgaagtacgttcccgggcactgatcggatcgaacggcaacggtgtcacgcccgatcgtgtatcatctggaaacgattcccgttctcaatccggcagcgataaagcctttgtggacgatggcaacttgaggaacggccctctcaccatcgccggagacggccaggatcttgaaggccgttctggcatgcatcgtttggcaaccgaacccgtcacgcacacaacaagcgaagatgatgttcggcaacggcctcatcgaaaacggcctcgcggtgatgaggaagagcagagcggcgcaaaactgaccagggtagacggaattcggacgggagtgacaatcagcgccgtaccggttgcccaggacgatccgattacatcgccgatccagccccctggatcaaatccgttggatgacccggggcagaccaacatcgctacggacgcattgcctccgacagccgatcgccggcagcagggagagccaaattctaagcgtcctcgtgatgatgacgccgagccgagcattcgtaagcggtcaagggacgggcgcagccaaggggatgagggaaacagaaggtag

SEQ ID NO: 112 - protein, 448 aa, Agrobacterium strain K599 (NCPPB 2659); identical to SEQ ID NO: 99

SEQ ID NO: 113 - DNA, 15867 bp, Agrobacterium strain K599 (NCPPB 2659)
  CDS (1)..(1089): rcorf12, weakly similar to riorf20 in pRi1724, similar to hypothetical protein Bcep02000338 [Burkholderia fungorum LB400].
  CDS (1272)..(2801): rcorf11, similar to riorf40 in pRi1724, a hutH gene homolog, a cd01441: HAL; Histidine ammonia-lyase (HAL) catalyzes the first step in the degradation of histidine to glutamate
  CDS (2972)..(3754): rcorf10, similar to transcriptional regulatory protein [Bradyrhizobium japonicum USDA 110], helix_turn_helix gluconate operon transcriptional repressor
  CDS (4015)..(6066): rcorf9, similar to A. tumefaciens C58 hydantoin utilization protein hyuA
  CDS (6069)..(7754): rcorf8, similar to A. tumefaciens C58 hydantoin utilization protein B
  CDS (8189)..(9088): rcorf7, similar to COG0834 Burkholderia fungorum LB400 COG0834, similar to STH1060, glutamine ABC transporter substrate-binding protein [Symbiobacterium thermophilum IAM 14863]
  CDS (9230)..(9952): rcorf6, similar to COG0765  [Burkholderia fungorum LB400], similar to PSPTO5181, cystine ABC tranporter, permease protein, putative [Pseudomonas syringae pv. tomato str. DC3000]
  CDS (10040)..(10807): rcorf5, similar to Bcep02000339 [Burkholderia fungorum LB400], similar to blr3310, COG0765: ABC transporter permease protein [Bradyrhizobium japonicum USDA 110].
  CDS (10809)..(12509): rcorf4, N-term similar to STH1062, similar to glutamine ABC transporter ATP-binding protein [Symbiobacterium thermophilum IAM 14863]; C-term similar to bll6362, hypothetical protein in Bradyrhizobium japonicum USDA 110, COG2079 [R].
  CDS (13484)..(14938): rcorf3, weakly similar to mlr6097, nitrogen assimilation control protein [Mesorhizobium loti MAFF303099], COG0583 [K] Transcriptional regulator
  CDS (15304)..(15867): rcorf2, similar to riorf1 in pRi1724, orf3 gene homolog in IS66
atgggaattttctttcgctcagcgccgattaaggcgatttcgtcgttgcgaccagccgagcaacctctatggtatatacctattcggggcgcggtctcactggctcgaatttttcttcggagcgcgctgaaaatgggaagattgatcgatatcgcgtggccggaacttcagatcacggtcgtggctgaattggcggatgatgataaccctgaattgtgcgaggaattttggcaggacctgccattcaaggtgatgcaggctcatcccgtcgtttccggcgagtccttatatgcttggacgccgacgatcagcaccgcgccggtgcggctgcgtcggcggatcgtcgattgtgccgttggggatctgagatactcccaggcgaccggcaataagttttccattcagtatggcaagggccttgagcccctggcgcagccggtgctgggacaggtacgtccggaataccaccatctgcttcccatcgtcggcaaagccatctggaacaatctgttcttcgcgaaggagaggatcttcgtagaggtaaggccacacgatcccgcggaagccttcaatggacagggccgcttcggaaacctcaagggcgtcgcagccgagttctacgccgaagccaagcgcatccagacggtagagccggaggatctgcgtaagatccgaacgggacagatcggcgataccgggacctacggtcagtttttcactgcctgggacttcgccaacggcatgctccgcgactatatcatgtacaccgcctacccgctcctcaaacttatcgatacgctctcgcacgacgactttgtggccgccgttgaagcattcgatcccgcgtattcggagtatctcggctattccggtcttaacacgctgctggatttctcgaacaaacttcgtatggcgatgaagcagacggacgacaaggaagaactcaaaacactgctccgcaccttcattatgtatggcaatcgcctatgcgcgtggtcctaccattacttcccgtggtatctaggaatgttctacgggcgagccgtcaacgggcaagagtttcacggtcgtttcaatccggttcagtgaacataatcaatccgttgccaccacgacggcattagagcggcacctctttagagccgctgttcgtatttttgctgcgcggcgctttacatttggtccattttcgtattggtatatacaaaatagaggacgcatggctattatgtatgcctctggatctcctgtccccctaaaaggttctaaacatggcccacgcgctcgttcccggaaaagtctcattggaaaccctggctgccgtttatgatggcacgctcgcacccgtgatcgatgccgcggcgctgaagagagtgcagatatccgccgacaaggtcgccgagatcgctgggggagatatcgctcactacggcatcaataccggtttcggcaaactggcgagtgtgcgcattcccgccgacgacgttgaaaccctccagcgcaatctgatcctgtcacattgctgtggggttggagcgccactcccggacggtatcgttcgcctcatcatgacgctgaagttgatctcgctcggcaggggtgcatcaggtgtgcgaccacaggtcataaacgttctctccgcgatgctcgaaaagaatgttctccctattattccggagaaaggttcggtcggagcctccggtgaccttgctccgctcgcccatatgactgcggcgctgatcggcgaaggtcaggcgaagttcgacggtgaggtcatgccagccaaagaggcattggcaaaggcgggcctcacccctatcgtcttgaaggccaaagaaggtcttgccatgatcaatggcacccaaacctcgacggcgctggcattggccggcctctttcgcgcccaccgagctctcatttcatccctcatttccggcgcgctatcgacggacgccgcaatgggttccactgcgccgttccatccagaaatccacaccctgcgcggccaccagggccagatcgacgtggccagcgcgctgagcaggctgttggcgggttccgaaatccgcgctagccatgaagagggggatgagcgggtacaagatccgtattgccttcgctgccagcctcaggtcgccggcgcctgcctcgatctgctacgtcaagccgccgccacgttgatgatcgaagccaatgccgcgacggacaacccgctcgtcctgtccgacggcacgatcgtatccggtggcaacttccacgccgagccagtagcatttgcggcggaccagattgcaatcgccgtctgcgagatcggcgcgatcgctcagcgccgcattgcgctgcttgtcgatccggtcctgagctatggcctgccggcgtttcttacgccgaagccgggcctcaactcgggtttcatgatcgcggaggtaacctcggccgcgctgatgtcagagaacaagcagatgtcgcatccggcatctgtcgactcgacccctacctcggctaaccaggaagaccacgtgtcgatggcctgccatggcgcgcggcgtctcctgcagatgaccgacaatctcttttcgattgtgggcatcgaggcgctgagcgcagcccagggtattgacttgagaacgccactcacctccagttcggagctcgatgcagttcgcaaggttattcgcaccgccgtgccgaaactcgaagacgaccgatacatggccgaagacctcaagcgcgcgacggagctcgttgcgaccggccgcctggcaacgcccgtttcgaaggatgttttgccgttgctctaatattcgactgaataagccgggaaggggcggctccctgcgttcccttcccgacgttcagaaagtttattgagctgttgcgatgagcacggttggtatacggccaaagcaccatatgttatagaccaataaaaggtttgtaatacaggtgaaagaggtacgactggtgactgatgctcgcttccttaacaatgaatcgaccagcaatggatgaagtcgcgacagacaaacaggcgtcgtcgcgttatctggagattcagcgtgacatcgaaaacaagatagccactggcgagtggggctccggcttccgcatcccgcctgagcgcgagttggttgatatttacaattgttcccgcatgacggtgaacaaggccctgtcgagccttgcagcctcgggcatgatttcgagaaagcgccgctccggctccttcgtcgcgccgccgcgtattgaagagccgctgatgcatattcaggatatccgcgcagaagtgctggcaatcgacaggacctatacgttcgagattaccgatcgcagcatccgaaaggccaccgacgcgctcgatgcgcggcatgtaggagtcccggttggcacacggctcctaaccctcgaagttatgcactatgccgacaatcttccgttcacaatggaaacgcggcagatcaatcttgacgccgttccacaggccgaacgccaacagttcaaagacgaaccgcctggaagctggctgcttcagaacatcccttttactgaaggcgagcattcaatccgcgccgtgtcggctgatacgatcctggcgaggaggctacaggtggtcgagcgcacggcctgcatttcgattgcgcgccggacttggctggagggcgacttaatcacattcgtgcgcctgatctaccctggcgaccgtcaccggttcgtcgtccgcttcaaaccgaatacgcttcccgtcggtccataagcggcgacttcgaacgataaggaacaagcagcgccctgtggcgctgttttttgtgacaagaagtgccgccaagaatccgaggcggcatccacttcaaaaaaactatgcacccaatttaataaaactgcactacgcaactctgatgctctgtctcaagatagctcatcaaacgctgaatgcagatgacttgccgacgtggccccacgggccatgcaggtatcgttttgccttcagacaagtgaggaaatgggaaatattcgatggcactggttaggattggcgtggatattggtggcaccttcaccgacttcgtaggatggcgagcggattccggaaaagggatcaagcgcctgaaggtgccctctactccaccgaatttcgcacagggtttccaaaacggtttcgagccgctactggaggcgcttgaggttgaggatggcgacgaagtcatcgtcatgcacggaacgacggtcagcacgaacactgtgatcgaacgctcggctgaaccggtagcgctattcgtaacggaaggcttcagggacatccttgagctgcagcgactgcgtctgaagaacccgatcgatctcttttcatcgcgcgccctgccgctggtgcccagaaacctggtcttcgaggttcccgaacgattgagcgcggatgccgaggtgttgaccgtggtagacgaaggcgcagtcaggaaggccgtagccgcggttcgcgccgaaggtgtgtcctccatagcagtagtcctcctgcacagcttccgcgatcctacacatgagcgaaaggtccgcgacatcatcacggcggcggcacctgaaatcgatgtctgcatatcgagcgacatctggcctcgcatgggcgaatacgagcgtgcggtcaacgcaaccctgaacgtctacgtcaagccgcgtgtaaagtcctatctccacgacattgagcagtatgtgaactcgcgcctgacttcggcgcgcctctacgtgacacggtcaaacggcggcgcgcttggcctcgccgacgccatgaactttccggtgcataccctattgtccggtcctgcttccggcatcaccgccgcccaaaccatcgccagcaccaataagcatgaatatatgctgaccttcgacatgggcggcacaagtacggacgtctctttggtccgccagggccaaccaacggtaacggcacaaggcgcggtcggcgatttcccgatcaccctgcccgttaccgaaattgaagcgatcggcgccggcggcggttctctggtgcggttgaatggtcctgcattgcgagtcggtccggagagtgccggcgcttttcctggaccggctgcatttgcccgcggcggcgacatgccgacggttacggatgcctacctcctgtgcggttatctgaacgccgagaatttcctcgggggcgcgatgcgcctcgatgtcgatcgcgccgcttctgcttactcctccgtggcgcagcagctcggcgtctcgactgccgaagcggctgacgcgtgcttgtcggtgactacctccaatatggtaagccgcattctgccctatcttgccgcccatggcctcgacccgcaaaacgtcaccctcgtgctattcggcggcaatggtgcgctacatggtccgcttctggccgatgaggtcggcatcaattcgatcatcgtgccgcccgctccctcggtcttctgcgctcggggcggggtcgtgacttcacttacacacgatgtcattgcggtgatccagggttcgaccgtcaccgacgaactcgtggcggcggaattcgaaaagctcaaggatgagaccctggtctggttatcgaaccagatcgacggatcccgactggtttcggtggaacacgagttctgggccgagctgagatataggggacagtcattccaagtcgcggtcgcagtgcctgtcagtcatggcagatttcccgatcttacgtctattgccaatcgtttccatgatgagcatctgcggctttacagccattgcgacacggctgcgccagtggagttcgttgaactgcgcgtgcgtgtccggggcagtctgcctatgcctccagacgagcacgctccacttgggcctcgtgctgaaattgcgcccgttgggcagcgcgacatccgcattgccggaaagctccatccttccgccagcacctatcggcgcaaggacctgactgtcggcagcacggtcaaggggccgtgcgtcatcgaggaggacgattctaccgtcctcgtaccagcagcatttcacgcgagcgccctcgcaaccggcgcactcgcactgacgcggaggcagtaaaaatggatcccgtacaaactgcaatcatggcgaaccggttcaacgcgatcgtcgaagaagcatcctcgacccttcagcgtacggctcacacaaccttcgtgaagctcgttcaggatttccagtgcgcattggcaaatgctgagggtgaagcattcgcctaccccgtaaataccggtgtcagcgccttcatcggactgtcggtcaagggcggtctcggtgatatcccaatttcctccctgaagcctggagactgcatcataaccaatgatccattctcaagcgacggcatggtcacccatatgatggatgtgtcgctggtgcatccgatcttccgcgacggccggctcatagcgctggcatgggccttcgtgcatgcctcagacatcggcggcgcggttcccggaagcatagcgccgacacttacggaaacatttcaggaggggctgaggctccgccccgtgcttctgtatcgcgagggagttctcaacgaggccgtcagaaacattttgctcgataacagccgcatctcatcggagctgtggggcgatatccaagcaatgttctctgctatgaagagcatggatgtgcgtctcggccaactctgtgatcggtattcgacgcaggaagtcatcgacgggatggatgcaacgctcgccctatcagaagcgagggcccgggaggttatcgccgaaattcccgacggaatttacgagttcgccgactacattgagggtatgaaggccggtgaattcatcaatatccatgcgaagatgacggtcaccggcagcgatttactgtttgattttaccggaacggatcctcaggtcctcgcagccttcaactatgtcactggctcgaccacacatccctataccctgcaatcgctaatctactatatcctgacaaaggcgccagacgctccccggaaccgtggccttctgcggccggtcaagatcatcgctccccgcggaacgatcatcaatgcgaacttcccagccgccggcggatcacgcgtcaccgcgtcgacccgcgtctacgacgttgtgcttggttgcttgaacgccgcaatccccggaggactggccgcagctggcccgggtatgtcggggatcatcgtggtcaccggacgcgaccgtcttcatggcggcaagcgtgtgagcgtgatcaatccaatttgcggcggcggtggcggtaaaataggacacgacggtatcgatggcgtcgacaaccggtcgggctcacttttgaccgtgccggcggagactatcgaagtcgaaactatcatgcgcgttcaacgatacggccttgtcatcgacagccaggcaccgggtcgttggcgcagcggcgcctcggtggtcctggatctggagaacaccgacgttgaggccgtcatgacggtgcgcggcatggatcggctcaaattcactccatggggtatcatgggcggcgaagccggatccctcgcgcgcgtcatcgtcaaccccgacacgaaggatgaacgtgagatcggcaagattgacgttctccacttcaagcggggtgacgtcgtccgcctgatcactccggcggggggcgggtttgggccagcgtcagagagagatcccgagcttgtgctcgcggacgtaaagcggggcgtcgtctcagctgaaaaaagctcgcgcggcctacggggtggtaattcgcgatgacttcacgatcgatatgaaggccactgaggcagccaggtcggccatgatcaagggcaacaaccgattctcgcattgtgaaacgcgacaggcgttcgacgccatctggcccatcgacgtccgggctgccctggccgtccgttcttttgattatgacgcttcggtcagagcaaccctcgtacgcaatacggtttcgcgcttcatcaaggaaagcaaaagagcgacgctcgatttaatcccgaatgcactcgcggaggaaaaccggcttttgcagcaatgacagcttagcggtgcgtccatgacaacaacagcggagaatagccagcgaccatcgcccattgccgaaaccaaaacacctggacgtaattctcgatcacaggagatgcgtcccgcgtagtgaaaacgatctaacatcgtgaagaagaaaggggaatacaatgagaattcgttcttacgcattgatcgtgaatctacttcttgccggagtctgtatcgcaccggcagcaaaggcggcggagccatccgaaggcaaagcatatgaaaacagccaggcggcttcgggaatcacgaagagcgtcgagccaaccgaaaaactggcgaaggccggcaagattgtcatgtgcaccgaactcggcaatccccccggcggcttcctggatgaagacggcgtcacgccgaaaggcttcaatgttgacgtaatgtcggcgattggcccggcgatgggtatcaaaaccgaagtcgtccactatccgttcgccagtatcttcgctgctttggacacgggtaaatgcgatgcagtcatgtcgaacaattcgaaaagtctagctcgcgtcgcaaaatacaatttcgtggagtacgtgcgcgagcggatgggcctccttgtcccgaaaggaaaccccctcaatatcaagacttacgaggatctttcaggacaccgcgtcgcggttctggtctcgagcaccaacgaacgcctactgaaggaagccaacaccaaggtcagcgccgaaggcaagccaccgatcgagatccagtcctatccgcagaatacggtcacgttccggcagctcgatctgaaacgtgtggacgctttcgtgagcgacgcgatgacactctcctacttcaagaagctcaccggcgataaatatgagatcggcggtctaccgatcgaccccctcaccatcggtattgtgcttcgcaaggacgaccctgcgctgcaagaagccgtacgcaaggcttatgtctctctctacgaaagcggctatgtcgagcaggccgccaagacctggggcatggacggccatgtcgagctttgccgcaacgacaagcagtgcccatgattttccgcagatgcccaacgctcgataggttcgagtaggtgtacactcctggcctgccgcttcggcggcagccctccgcgcaagaggtaaggtcctcggcaacggaactcgaacacaataagaaacggggacattatcgacatgcagttcgatatcgcctttttcctggattttgtcttcaatccccggcccgcccttctgcgcggtctgctcacgacggttctggtcgcgttcgcgtccatggtcatcggtgtggtgttggggcttgtcttgtccctgttcggactatcacgatggcgcgtgctccgctggttcaacagcgcctacatcttcgtgtttcgcggcacaccgctccttgtgcaggtcattctgatctatttcggcctcccctatctgacgaatgtcgatctttttccgcaggacgtgcatctgttcggcttcatttcgatcagcggggcgattgtcgcgggggtgaccgccttcgcgctccatgaggcggcatacttcagcgaaatttctcgcggcgctatcgcttcggtcgaccatggccagtgggatgccggcagggccgtcggcatgacgccggggcttctcatgcagcggatcattctgccacaggcaattcgcatcatgttgcctccacttggcaatcagatgaacggcatgttcaaggcgacatcgttgctgtacctgatcgcggttccagagatgctgtttatcaccgacgcagtgaattcagtgacctacaaaaccttcgaggtctatctcggcgtatcgatctactacctcgcgctcacaaccgcttggagctttctccaagaagcattggagaagcgttattcaaagggcttcgtttcgatatgacctggtccgcacccaattcggcgagcgtagtcgctcgaacgccactcggtctcatgaaggcggcgaagttgctccgggagctcaatcatgaactttgacctgcactatttcctcgagctggttttctcgccaccaccgcagcttatatatgctgtctggctcaccgtctccgtcactctcacatcaatggcggtcgggatcattgcgggactgttcctggcactattcggactgagcctgtatggcgcgcttagaggtttcaactggctttacgtctggttcttccgaggaactcctatcctcgtgcagttgtttctaatctattttgggctgccctacctgatcggtgttgacatcttcccgtcgacaatcacgacgccggcgttttccatcagcggagcgattgtcgctggcatattcgcattcagcttgcacgaagcagcatatatgagcgagatcacgcgggccggcatccgatcggtcgagaaaggacaaagcgaggccgcacaggcattgggcatgttgccgtcgttggcgatgcgccggatcatcctcccccaggcgcttcgcatcatcctcccctcgctcggaaaccaatgcaacatgatgttcaagaccactgcgttcctgagcgtcatcgccgttccagaactcgtacacgtcgccgacagcctgcgatcgcaaaacttcaagaccttcgaagtttatgcggcgatctccgtctactatctcgtgctgaccggggtgtggaccgtccttcaacaatggatcgagaaccggctgtcctggagtcctcgcactgctgcgcgcgagcccgagtcgaacgcccccaacctgttacagatggaaacctgaaatggccgatcaatccaaagccagcgtggcacctgccgtggaactccgcggcgtaagcaagtcgttcggtaccctgagcgtgttcaagaatgtttcaatgacggtccaacctaaggagaccgttgtcgtcatcggtccgtccggctccggcaaaacgacgcttatccgttgtatcaatcatctggagcaaatccagagcggtgagatctacctgaatggcgcacttgtgagcaacaagctcgcaggcggtaaaaaggtcccactcagcgagaaggaaaaggccgcaatccgcaggaatgttggcatggttttccagcgcttcaatctatttccgcatctgaccgctctgcagaacatcatcgaggctcccgttcatgttctaaagcgcccgaggcaagaggcgatccaggaaggaattgccctgctggagcgcgtcggattggccgataagcgagatcagtatcccgcgcaactctcgggtggccagcagcagcgtgtagcaattgctcgcgttctcgcgatgaagcccgagattgttctttttgacgagccgaccagcgcacttgatccggaaatggtcggcgaagttctctctgtcatgaaagaactcgccggcaagggcatgaccatgatcgtcgtcactcacgaaatgggtttcgcacgagaggtggccgaccgagtcgttgtgatggataagggctccatcattgaacaggggccaccagagcagattttttggtcgcccccaaaacgctcgcacggccgaattcctggagcgaatctcctaaacagttggcgaattacggccggcgtctccgctaggtgcccaagacatggcctgttttcttcatttccaaggcgcacaagtccgaacattgtcatgtccataacagccgagctttccgacttcatcgcccatgtgcgggaagtgcctcagtctgtgtccgagcgcgcaaagatccatgtggccgacacactcgcttgcatatatgctggcacggcgtctcggcctgtagaaattctcgttgcagtatgcgcaccagggaacgatcgggagggcattcccgtccctggtctaggttgctggagcgatcctgcactggcggctcttctgaccggcacctgcgcgcatgcagacgactttgatgatacgagcgagttctcgatgaatggccatccgagtgccccgatcgtcagtgcgctgctgccgacggccttcgaaacgcaagcgagcggccgggcattcctgcggtcctatgcagtcgggatcgagatcgcctgcaagcttggcatcgcagtgggcagcgcacatacgcgccaagggtggcatacgatgtcgacgctcgggactctcgcagctgccggcgctgcggccaacttgcgtggcctcgacgcgcgccaaacggagcacgcactcgcgatcgcgtgctcctttgccgggggcatccttggcaacaccggaacgatgacgaagagtttgcattgcggccgggccgctcaagctggcttccttgctgcaaagctggcagaaagcgacttcacggccggatctggcatccttgaggcaccatccggtttcctggatgcattcacaggcggatcagcagcaacgttgccagctctcggcaacccttgggaacttgttactatagggcacgcgtggtcgacggcccgggctggtctgcacccatcttgcaattgatggcgcattgacgatccgagcgctgtctggtttcgacatcaaagcgatcgaacggatcaactgtttcgtccgcgacgagtgcatccgctatctgcgctttccgaagccgagaacgggaatcgaggcgaagttcagcatgaactatacggtggcgaccgccctgctccaaggcgagttaacgctgaacgattttgaaacgaacgccatcgcacatgaggacgtttccgagctattggtcaaggtggcgatgttcgcgcggagtgaggattcggacaaccccgacatcgaagtggtcttcctggacggaaagcgactggccgagcggcggcgtgtgccgcgaggggcgcccgacgatccagccggatgggaggaaatcaccaggaaactggcgggaggcatttcccgcgcaaggcagtcgagggtggccgatttcggaaagcatgtttgggcgatccgtgatctggacaaggcaacccggttgtccgatatcttttcagcatagggtctccagagctcgcgcaaggttctgatgcgcacattcatccgaggttagtatgcccaagatcgactttccgcatctggcagctttcgttgtcagttgcgacagtccaacgatggcgcatgcggccgcgaagcttggttaattaacggcggcattgagtgccaagctcagcacgctcgaagcccagattggagtgacgctttttggtcgcaaagggcgtaactcctttccgctacgctcggcggtctggctgtacaatcgcagtgttcgtctcctccttgccgaggaatatttgagtcatgccaaacttggcggcagcgcggcgccttcggcgcccgtcatcctcaaattagacgttgactatacctggacagcaatttcctacgctgtaatcacggcgatccgccgcttccattccaaacccgaccacccttatgtagacttgatcttcacgggtactggcgccttcggaatgcagaacggtcccagccatcttctgtcagacgcggtgccactcgggcagctcaagatccaacataccatcggtactggggtatccggaccttctgttgtcgttgctccagaccattggacgaggctgacccatacggttggggagcgacccgagcgtggtgacattgctccaaaaaccgaaattcccgatctgccgggtacactgcaaagcgacacgaaattcgaccgctccagcggtatcgcgacatcacggatttccaccaccgatcgaagtctgcaggatctccgagggctcatcgacgacatccgcaagtcggatctacttctgccccaactgactgtaccccagcgtcttcgcatccagggcatcactgcggttccggtaattcgcagtccgtcgtgctgcgtgaccgcagagctctctaacgaccatgaacttctgttaaatctgctaaatgatgtccgcaaaggcgtcgaggccccttcgggctggtccgaagccacgaatttccatcccaaggttagcctgaagcagatttctaccgtgaatcgtgtggtgcagaccggcagcatggcgagcgctgcccgcgtcgccggacggactgctccgatgataccggcccagcttgaacagatcgaatatgcgctcgggacaaggcttatcgaccggaagaagaccggttctgaaccgaccgatgatgctgaaaggctgcattcgctgtttgtcggcgttgagagggctttcaacgacactctgggcgaacgaagccacatagctgcggcctttgaacaatcaattcggattgcgttaccggtgagttggagcgcagattccttgacgtccgaatgcatggccgtggcgcttagcgcatttcacaatgaatttccgaactgccaaatcgaggttgtggagggccctcgacatgtactgcatcatggcgttctaaccggccgtttcaatattgctgtcgttggtaggatcgatccgcaagtaggctctctactaattggccgcagcgaagacgtcgtcctgatcgtcaataggaagctgaattttgcgcctcaggccgagagagtttcggcagacgagctgaggagcatcccgctccttctggcaccttcacagctcacaatgcatcaaactcttctgacggcacttgcgaagtctactgtgcagctcgagccggtaatgcggttgggttcggtacctctgatcgtctcggttttgcgtcgttcacctcttggcacgatcttgccagcgtcggtgatgatcaaggagatcgaggcagggatcgtggacacgttctctctcgaccatttagtcccgccgcggcgactatgggcaatattctccacctccacgccgcttaacgagactgaacgtgctttgatcagccacgtaaaggaagcgtttcaggaggctaattcatccaacggcagagttgtaccttaacttatagagggtacagcctgcgacagcttcgcgcgttacagcacatgagctggtggtgaggacaatgcgcttagcggctcacaacggggcaaggtcagcgcgcccgacgcatgtctacacgatcgattatgttgcttcgctgatcggcgagaacctcgaactcctccaggaaatcgccagcaactcagacaatatcgattacggcgagatgatccatgcccatgacggcagccaagagggcgtcacgaccttcaccgaccggggcatcgagagcttaaaggaattggatccgggcccaaatactcagttgacaaagggtataggtcagcagggccacatatggacggccgcaacaagcccccgatatgttcggcagaacatattggcggctacaatccgctgttcaaggtagaccgcgatccggggccgctgacgcaggcgctctgctggtcgcacgcgaggcgcaagttcttcgtgctggccgacatcgccacgaatgccaaacgcggcagccgcgccgcaccgatctcgcctatggcgttggaggccgtcaaacggatcgatgccctgttcgacatcgagcggcagatcaacgggcttgccgcagcggaacgcctggagcgccgtcgcaaggacagcctgccgcttgtcggcgaactgcactgctggcttcaaaccgaacgggcaaaactgtcgcgcagttctccagtcgccgagccgatcgactacatgctgaagcgctggaacggcttcacgtctttcctcgacgagggcaggatttgtctcacgaacaacgcggccgaacgagcgctgagaggctttgctctcgggaggaagtcatggctcttcgccggatcggatcgaggtgccgatcgcgccgccttcatggcgacactgatcatgacagcattatgccgcgcgcggcataa

SEQ ID NO: 114 - protein, 362 aa, Agrobacterium strain K599 (NCPPB 2659)
MGIFFRSAPIKAISSLRPAEQPLWYIPIRGAVSLARIFLRSALKMGRLIDIAWPELQITVVAELADDDNPELCEEFWQDLPFKVMQAHPVVSGESLYAWTPTISTAPVRLRRRIVDCAVGDLRYSQATGNKFSIQYGKGLEPLAQPVLGQVRPEYHHLLPIVGKAIWNNLFFAKERIFVEVRPHDPAEAFNGQGRFGNLKGVAAEFYAEAKRIQTVEPEDLRKIRTGQIGDTGTYGQFFTAWDFANGMLRDYIMYTAYPLLKLIDTLSHDDFVAAVEAFDPAYSEYLGYSGLNTLLDFSNKLRMAMKQTDDKEELKTLLRTFIMYGNRLCAWSYHYFPWYLGMFYGRAVNGQEFHGRFNPVQ

SEQ ID NO: 115 - protein, 509 aa, Agrobacterium strain K599 (NCPPB 2659)
MAHALVPGKVSLETLAAVYDGTLAPVIDAAALKRVQISADKVAEIAGGDIAHYGINTGFGKLASVRIPADDVETLQRNLILSHCCGVGAPLPDGIVRLIMTLKLISLGRGASGVRPQVINVLSAMLEKNVLPIIPEKGSVGASGDLAPLAHMTAALIGEGQAKFDGEVMPAKEALAKAGLTPIVLKAKEGLAMINGTQTSTALALAGLFRAHRALISSLISGALSTDAAMGSTAPFHPEIHTLRGHQGQIDVASALSRLLAGSEIRASHEEGDERVQDPYCLRCQPQVAGACLDLLRQAAATLMIEANAATDNPLVLSDGTIVSGGNFHAEPVAFAADQIAIAVCEIGAIAQRRIALLVDPVLSYGLPAFLTPKPGLNSGFMIAEVTSAALMSENKQMSHPASVDSTPTSANQEDHVSMACHGARRLLQMTDNLFSIVGIEALSAAQGIDLRTPLTSSSELDAVRKVIRTAVPKLEDDRYMAEDLKRATELVATGRLATPVSKDVLPLL

SEQ ID NO: 116 - protein, 260 aa, Agrobacterium strain K599 (NCPPB 2659)
MLASLTMNRPAMDEVATDKQASSRYLEIQRDIENKIATGEWGSGFRIPPERELVDIYNCSRMTVNKALSSLAASGMISRKRRSGSFVAPPRIEEPLMHIQDIRAEVLAIDRTYTFEITDRSIRKATDALDARHVGVPVGTRLLTLEVMHYADNLPFTMETRQINLDAVPQAERQQFKDEPPGSWLLQNIPFTEGEHSIRAVSADTILARRLQVVERTACISIARRTWLEGDLITFVRLIYPGDRHRFVVRFKPNTLPVGP

SEQ ID NO: 117 - protein, 683 aa, Agrobacterium strain K599 (NCPPB 2659)
MALVRIGVDIGGTFTDFVGWRADSGKGIKRLKVPSTPPNFAQGFQNGFEPLLEALEVEDGDEVIVMHGTTVSTNTVIERSAEPVALFVTEGFRDILELQRLRLKNPIDLFSSRALPLVPRNLVFEVPERLSADAEVLTVVDEGAVRKAVAAVRAEGVSSIAVVLLHSFRDPTHERKVRDIITAAAPEIDVCISSDIWPRMGEYERAVNATLNVYVKPRVKSYLHDIEQYVNSRLTSARLYVTRSNGGALGLADAMNFPVHTLLSGPASGITAAQTIASTNKHEYMLTFDMGGTSTDVSLVRQGQPTVTAQGAVGDFPITLPVTEIEAIGAGGGSLVRLNGPALRVGPESAGAFPGPAAFARGGDMPTVTDAYLLCGYLNAENFLGGAMRLDVDRAASAYSSVAQQLGVSTAEAADACLSVTTSNMVSRILPYLAAHGLDPQNVTLVLFGGNGALHGPLLADEVGINSIIVPPAPSVFCARGGVVTSLTHDVIAVIQGSTVTDELVAAEFEKLKDETLVWLSNQIDGSRLVSVEHEFWAELRYRGQSFQVAVAVPVSHGRFPDLTSIANRFHDEHLRLYSHCDTAAPVEFVELRVRVRGSLPMPPDEHAPLGPRAEIAPVGQRDIRIAGKLHPSASTYRRKDLTVGSTVKGPCVIEEDDSTVLVPAAFHASALATGALALTRRQ

SEQ ID NO: 118 - protein, 561 aa, Agrobacterium strain K599 (NCPPB 2659)
MDPVQTAIMANRFNAIVEEASSTLQRTAHTTFVKLVQDFQCALANAEGEAFAYPVNTGVSAFIGLSVKGGLGDIPISSLKPGDCIITNDPFSSDGMVTHMMDVSLVHPIFRDGRLIALAWAFVHASDIGGAVPGSIAPTLTETFQEGLRLRPVLLYREGVLNEAVRNILLDNSRISSELWGDIQAMFSAMKSMDVRLGQLCDRYSTQEVIDGMDATLALSEARAREVIAEIPDGIYEFADYIEGMKAGEFINIHAKMTVTGSDLLFDFTGTDPQVLAAFNYVTGSTTHPYTLQSLIYYILTKAPDAPRNRGLLRPVKIIAPRGTIINANFPAAGGSRVTASTRVYDVVLGCLNAAIPGGLAAAGPGMSGIIVVTGRDRLHGGKRVSVINPICGGGGGKIGHDGIDGVDNRSGSLLTVPAETIEVETIMRVQRYGLVIDSQAPGRWRSGASVVLDLENTDVEAVMTVRGMDRLKFTPWGIMGGEAGSLARVIVNPDTKDEREIGKIDVLHFKRGDVVRLITPAGGGFGPASERDPELVLADVKRGVVSAEKSSRGLRGGNSR

SEQ ID NO: 119 - protein, 299 aa, Agrobacterium strain K599 (NCPPB 2659)
MRIRSYALIVNLLLAGVCIAPAAKAAEPSEGKAYENSQAASGITKSVEPTEKLAKAGKIVMCTELGNPPGGFLDEDGVTPKGFNVDVMSAIGPAMGIKTEVVHYPFASIFAALDTGKCDAVMSNNSKSLARVAKYNFVEYVRERMGLLVPKGNPLNIKTYEDLSGHRVAVLVSSTNERLLKEANTKVSAEGKPPIEIQSYPQNTVTFRQLDLKRVDAFVSDAMTLSYFKKLTGDKYEIGGLPIDPLTIGIVLRKDDPALQEAVRKAYVSLYESGYVEQAAKTWGMDGHVELCRNDKQCP

SEQ ID NO: 120 - protein, 240 aa, Agrobacterium strain K599 (NCPPB 2659)
MQFDIAFFLDFVFNPRPALLRGLLTTVLVAFASMVIGVVLGLVLSLFGLSRWRVLRWFNSAYIFVFRGTPLLVQVILIYFGLPYLTNVDLFPQDVHLFGFISISGAIVAGVTAFALHEAAYFSEISRGAIASVDHGQWDAGRAVGMTPGLLMQRIILPQAIRIMLPPLGNQMNGMFKATSLLYLIAVPEMLFITDAVNSVTYKTFEVYLGVSIYYLALTTAWSFLQEALEKRYSKGFVSI

SEQ ID NO: 121 - protein, 255 aa, Agrobacterium strain K599 (NCPPB 2659)
MNFDLHYFLELVFSPPPQLIYAVWLTVSVTLTSMAVGIIAGLFLALFGLSLYGALRGFNWLYVWFFRGTPILVQLFLIYFGLPYLIGVDIFPSTITTPAFSISGAIVAGIFAFSLHEAAYMSEITRAGIRSVEKGQSEAAQALGMLPSLAMRRIILPQALRIILPSLGNQCNMMFKTTAFLSVIAVPELVHVADSLRSQNFKTFEVYAAISVYYLVLTGVWTVLQQWIENRLSWSPRTAAREPESNAPNLLQMET

SEQ ID NO: 122 - protein, 566 aa, Agrobacterium strain K599 (NCPPB 2659)
MADQSKASVAPAVELRGVSKSFGTLSVFKNVSMTVQPKETVVVIGPSGSGKTTLIRCINHLEQIQSGEIYLNGALVSNKLAGGKKVPLSEKEKAAIRRNVGMVFQRFNLFPHLTALQNIIEAPVHVLKRPRQEAIQEGIALLERVGLADKRDQYPAQLSGGQQQRVAIARVLAMKPEIVLFDEPTSALDPEMVGEVLSVMKELAGKGMTMIVVTHEMGFAREVADRVVVMDKGSIIEQGPPEQIFWSPPKRSHGRIPGANLLNSWRITAGVSARCPRHGLFSSFPRRTSPNIVMSITAELSDFIAHVREVPQSVSERAKIHVADTLACIYAGTASRPVEILVAVCAPGNDREGIPVPGLGCWSDPALAALLTGTCAHADDFDDTSEFSMNGHPSAPIVSALLPTAFETQASGRAFLRSYAVGIEIACKLGIAVGSAHTRQGWHTMSTLGTLAAAGAAANLRGLDARQTEHALAIACSFAGGILGNTGTMTKSLHCGRAAQAGFLAAKLAESDFTAGSGILEAPSGFLDAFTGGSAATLPALGNPWELVTIGHAWSTARAGLHPSCN

SEQ ID NO: 123 - protein, 484 aa, Agrobacterium strain K599 (NCPPB 2659)
MQNGPSHLLSDAVPLGQLKIQHTIGTGVSGPSVVVAPDHWTRLTHTVGERPERGDIAPKTEIPDLPGTLQSDTKFDRSSGIATSRISTTDRSLQDLRGLIDDIRKSDLLLPQLTVPQRLRIQGITAVPVIRSPSCCVTAELSNDHELLLNLLNDVRKGVEAPSGWSEATNFHPKVSLKQISTVNRVVQTGSMASAARVAGRTAPMIPAQLEQIEYALGTRLIDRKKTGSEPTDDAERLHSLFVGVERAFNDTLGERSHIAAAFEQSIRIALPVSWSADSLTSECMAVALSAFHNEFPNCQIEVVEGPRHVLHHGVLTGRFNIAVVGRIDPQVGSLLIGRSEDVVLIVNRKLNFAPQAERVSADELRSIPLLLAPSQLTMHQTLLTALAKSTVQLEPVMRLGSVPLIVSVLRRSPLGTILPASVMIKEIEAGIVDTFSLDHLVPPRRLWAIFSTSTPLNETERALISHVKEAFQEANSSNGRVVP

SEQ ID NO: 124 - protein, 187 aa, Agrobacterium strain K599 (NCPPB 2659)
MFGRTYWRLQSAVQGRPRSGAADAGALLVAREAQVLRAGRHRHECQTRQPRRTDLAYGVGGRQTDRCPVRHRAADQRACRSGTPGAPSQGQPAACRRTALLASNRTGKTVAQFSSRRADRLHAEALERLHVFPRRGQDLSHEQRGRTSAERLCSREEVMALRRIGSRCRSRRLHGDTDHDSIMPRAA

SEQ ID NO: 125 - DNA, 1362 bp, Agrobacterium strain K599 (NCPPB 2659)
  CDS (1)..(1362): rcorf18, similar to AGR_L_1821 hypothetical protein [Agrobacterium tumefaciens str. C58], a sdeB gene homolog, cd01298: ATZ_TRZ_like; TRZ/ATZ family contains enzymes from the atrazine degradation pathway and related hydrolases
atgaaggaattgaacagttcagcacttttcgcacggaaggcccttcttccgagcggctggcacgacaatgtcagggtgttggtcgagagcggaaccatcgcgtcggtatcgaccgatgctgatcctgcaccatccgacgaacaccatcaaatcattctgcctgcgatgggcaatctccatagccacgcctttcagcgcgcaatggcaggtctggccgagacccgcgggccgtcagatgacagcttctggagctggcgaaatgtaatgtaccggttcgccttgacgatgagccccgacgatgtcgaggctgttgcgtcccagctctacatggaaatgcttgaagcaggtttcagccgtgtcggcgagtttcactacctgcatcatagcccggatggaaaccattactccaacattgcggaaatggcggaacgagtcgcagcggccgcgagtgccaccggaataaacttgaccctgctacctgtcttttacgcccactcggatttcggcggactcgaaccggtggaggggcaacgacgatttatcaattcgctcgacagcttcgaacgactaatggttgcgtgccgatctctagtcgcgaaaatcgacggcgccgagcttggtgtcgcaccacacagcctgagagccgtcataccgcaggaactgcttgcggtcacctcaatgtctggcggagggccaatccatatccatatcgccgagcagatgaaggaagtttcggattgtattgcctggtcctctgctcgtcctgttgaatggttgttggacaatgcacctgtggaccagcgctggtgcctaattcacgcaactcatatgaccgaaatcgaaacggcaagaatggcgcggactggcgctatcgctgggctttgcccgattaccgaggccaatcttggcgacggtatttttccaggccaaattttctgcgaacaaggaggccgtgtcggcattggttccgactcgaacgttctcatttccctgaacggagagctgcggcaacttgaatattcacaacgactgcgactccaagcacgtaacgtcctggcagcgccgggcggctcaacgggtcgcaatcttatcgtctctgccgtccgcggcggcgccatggcgctgaacgcggagagtggcattgaggtacacaattctgccgacatgctttcactcaatctcacagaagttccctatctcgaagatgacgagatcctggatcattggatctttgcagatggggttgcgatcgacaacgtttgggttcaaggccgcagacaagtggtagccggtcgccacgtcgcccgagacaagatcaatcgacgcttcctcaccacaatgcagaagttggttcgccgctga

SEQ ID NO: 126 - protein, 453 aa, Agrobacterium strain K599 (NCPPB 2659)
MKELNSSALFARKALLPSGWHDNVRVLVESGTIASVSTDADPAPSDEHHQIILPAMGNLHSHAFQRAMAGLAETRGPSDDSFWSWRNVMYRFALTMSPDDVEAVASQLYMEMLEAGFSRVGEFHYLHHSPDGNHYSNIAEMAERVAAAASATGINLTLLPVFYAHSDFGGLEPVEGQRRFINSLDSFERLMVACRSLVAKIDGAELGVAPHSLRAVIPQELLAVTSMSGGGPIHIHIAEQMKEVSDCIAWSSARPVEWLLDNAPVDQRWCLIHATHMTEIETARMARTGAIAGLCPITEANLGDGIFPGQIFCEQGGRVGIGSDSNVLISLNGELRQLEYSQRLRLQARNVLAAPGGSTGRNLIVSAVRGGAMALNAESGIEVHNSADMLSLNLTEVPYLEDDEILDHWIFADGVAIDNVWVQGRRQVVAGRHVARDKINRRFLTTMQKLVRR

SEQ ID NO: 127 - DNA, 13703 bp, Agrobacterium strain K599 (NCPPB 2659)
  CDS (1)..(789): rcorf31, similar riorf59 in pRi1724, similar to orf3 gene in Methylobacterium extorquens, COG3931 [E] Predicted N-formylglutamate.
  CDS (1064)..(2455): rcorf30, similar to riorf58 in pRi1724, a eutB homolog, ethanolamine ammonia-lyase heavy chain
  misc_feature (2452)..(3198): rcorf29, similar to riorf57 in pRi1724, a eutC homolog, ethanolamine ammonia-lyase light chain.
  CDS (4368)..(9674): rcorf28, probable GALLS gene, similar to riorf55 in pRi1724, complements virE2, unknow mechanism, required for efficient stable plant transformation.
  CDS (10739)..(11518): rcorf27, probable trans-zeatin synthase, similar to riorf54 in pRi1724, EC 2.5.1.-.
  CDS (11586)..(12185): rcorf26, probable idi gene, similar to riorf53 in pRi1724, similar to idi, isopentenyl-diphosphate delta-isomerase [Mycobacterium tuberculosis CDC1551] EC 5.3.3.2.
  CDS (12412)..(12825): rcorf25, similar to riorf52 in pRi1724, similar MCA2182 decarboxylase family protein [Methylococcus capsulatus str. Bath]
  CDS (13245)..(13703): rcorf24, similar to riorf51 in pRi1724, weakly similar to mtrR gene of the tetR bacterial regulatory family.
atgggtaaattgtcgttgctcgcccctggcgagtctgcaatcgcgatcgaaaacaaggccgcgctcggcaagtttgtaatcgtatgcgagcatgcttcacacctgatcccgccttcactcggcgacctcggccttgatgcgtctgcgcgttcaagtcatatcgcctgggatccgggcgccctggaactcgcacgatatctttcgtcatctctcgatgcggtcctctattaccagcgcttttcgcggctcgtttacgactgcaatcgcccgccggaggcagtgtctgcaattgttggcaaaagcgagatctatgacgttccgggaaatcagagcatgccggaagcagatcgcctgacgcggatcaacgagatttatctaccctttcgtgatggactgtccgaaattctcgcctctcgcaaggcccaggggcgcgggacgatgctcgtcacagtccatagtttcacccccgtctatttcggcaagaagcgcgaggtcgagatcgggatattgcacgacagcgacacgacgctcgcagatgcaattctcgcggaattcgaaggggccgatcgcaagtatgtcgtcatgcgcaaccagccatacggtccagccgatggggtcacgcacacgctcgtcgagcacggcatcgcgaacggtattccaaatgtcatgatagaggtgagaaatgacctcctggtggccgcggatgaccaagctgcggttggcagctatctctccaggctcattggaaaggcagcctcgacagtgaaggccgggcaaacggtcagttgaagccgcctcgggcaatcgagttccgaacgcctcatgatccatggcggatccgaaatgcttcggtcacggcttgcatcgtccggaggcaccttaggagcacaagcccttcgatgaatggaccgcgcgcgcccaagccaggagtggcatggatcgtgcatagctttcaggaggcatggcgcccgcactgcccagttcgggctggacttacaatcttgaaggtagcttcgcccttgcgcaagaaatgggctgcctgatacccacgagcggagataaaatgtattcgatcatacttggacgcgagcgccatgtcttcgccgacctgaaatcggtcatggcctgtgcctcgccactcaagtcaggcgatgtgcttgcgggggttgcagcgtcaagcaacgagcggcgggtcgctgcccgctgcctgcttgccgacatgccgctcaagacattcctggaggatctgttgatcccctacgaagtcgacgaggtcagccggttgatcatcgatcgccacgacccaattgccttcgcgccagtttcacatatgacggtcggcgagtttcgcaattggcttctctcctacgacgcgacaaccgaaaggctggcagcacttgcgacgggcctcacgccggaaatggtcgcggcggtctccaagatcatgcgcaatcacgatctgatcaccgttgccggtaaatgtaacgtggtcactgccttccgctccaccatcggcctgccgggcaggctgtcgagccggctccagcccaaccacccgaccgacgatccagaaggcgtcgccggttcgacactcgacggccttctctacggaatcggcgatgcggtgatcggcataaatcccgccaccgacaacctcgatgcctgcaccaggttgatggtccttttcgaccggctgcgcgagcggttcgagattcccacccaatcctgcgtgctgactcatgtcaccacttccatcaaggcgatcgaggccggggcgccgctcgatcttgtgttccagtcgattgccggcactgaggctgccaacaatggtttcggcgtcgatctcgccgttctcagggaaggcaatgacgccgcgctgtcgatgaagcgcggcagcgtcggaaacaacgtgatgtatctggagaccggtcagggcagcgctctttcggcagatgcacatcacggcgtggatgaacagacggtcgaggtgcgggcttacgcagtcgcacgtgaactccgcccgctgctcgtcaacaccgtggtcggtttcatcggaccggaatatctgttcgacgccaaacagatcattcgcgccgggctagaggatcatttctgcggaaaactgctcggtgtgccgatgggggtcgatgtctgctataccaaccatgccgaggcagaccaggacgacatggacaatctgatggtgctattgactgtcgcgggcgtcagtttcatgattgccgtgcccggcgctgatgacgtcatgcttaactaccagagcctgtcttatcacgatattgtcggcctcaggcatcagttcaatcgtccgccggcgcccgaatttgaggcttggctcaatcgcatgggcatgcttgatcactcgggccggctggcgcccgccagcgcctcgggccaattctctcgcaatctcttgagctacggggtgtccgcatgagttggggtcgagacccgtttgagcgcttccgccattcgacacgcgcccggattggactcggtagagcgggcgacgcgttgccgacctcggcaattctggatttccagctggcccatgcgaaggccagggacgccgtgcacggtcaagtggattttgtcgccctcgccaagcagcttgcaccggtatcaacgatccggatcaggtcctgcgccacggatcgtaccatctacttgtcgcgcccggatctgggtcgccagccgcttgcagccgatcttccaatgccaggggatagccatgacatcgcgttcgtcatcgcggacgggctttccgcctcggcggtcgagcgtcatgccgttccgcttttcaaggcatgcatgaagcgtcttggcggcttcagtgtcgccccggtgattttgggcgaacaggcgcgggtagcattcggcgacgaggcggcggcggcgttcggtgcggaggttgcaatcgtcctgatcggcgagagaccggggttaagcgtgcctgacagtctgggtgcctacatcaccttccgcccccaggcaggacggcgcgacagcgagcgtaactgcatttcgaatattcacgccgacgggctcggctacgagattgccgcggataagatcgcctggatcgtccgggaggcgctgcgcttgcagttgagcggtgtggcgcttaaggagggtgccgagagttcggcaaaaatctcttcgaaccctgggcaagaatgaagcctgaggcgcgatcaccgagggctgtcctgacgctcccctctcgttcggtgggcgagcctcttggaatcaccccgagtgcgaaaggttcaccgttcggatcggggagggcaactcggaactcttgcctagccacctgcttgacggcagctttgtcggcaatggccttggtcacacccgacgccatccgcggtgctggggaggcaaaccgggcgagaggtccgaccggccgacgagatcgcaaagccgtgcggcctcaccccgcgcgcgaggcgctcgccgcgttgctcgctttgccatcgctgcattctgctgatgatttggtctatcaggttgactgccgtattgacctcggcaaggcggaccgactgttcgcgtgccgacgtcgcgctcgagtccgcgtcatgatttaccgtgacgatatagccttcgatggtcttcagcacctgaccggtttcgctcgccagcttgacgccactctggacttccgcaggcgtgaactgcgcccagcgctctgcgagagtgtggtcgcacggggtgcaatcaagctccaggagacgatcatgaagcttcccagagtcattacgacaataagaccgaaatccgcacagaggtgcaatattcgtgttccttgagttaagccgagcgacatggttggtcacatcattgtcggtaggtggcggtgagaagatctcgaagcatacggttcagcacgcagacgtcggcggactgttgtcgcgcttcgcctaaaggcatgaaagtcgcgtttcaacgaacaggctcgatcgaaccagcgacccaacgttaatgattacaaactgcaaaccgtaacccttaaaggtaaacatttccaaagtttcatttgtagcgattttgaatttttcatgtgtagaagcgttcctgatatcaagttatagtcctcgcaatcgatccaccatagaaagattgctcatctgagcttaaggaattcaattcttcctcagatatacttggagccacgcgggccatctaactgacttctaggttttgatgaacaccatgtcccctcaatggctttgagaccgcaccggatgctcattgagttttgaaatcagcaccgttaccgaactttccatcctggctggctgatcacacacgattggaaagcgaggggaataggagtggcaagcatgccaaccgacgacattgtaatgtccgatcccggaatggctgctgttgacacgtctgtccctacgcgcttccagacagatcttcgccagttcagtaacctgctggacgagagcaatattgtggaatgggtcgtaaaccacgccgcaaatcgcaatgcgtgcttcggacaagaccaacttaagatttcggcggctcgggcactcacgcactacaaacggccggtacaagaaatcgacctgctattccaacaggtcgtcgcaagcgacaaactgacccggcttgattctccagatggccaacctctctacacctctacagagctgagagctgcggaacagaatactgtacgtcatgtcaccaatctttccgcagaagaaagcttcggcgttccgggaaccattgttgatatggtcgccgatagaggcattttcacaccggagctcagaggagcattacattatctgtctaggcgaaatcgagcttccactatggtgggcgtagcgggttccgcaaaaacaagtgtacttggagccctgaacgaagcggtggacaggttcaacgaggaagcgctcccgaccgagaaaataaagttgattgccttcgtacccaccaaccgggcggcccaggagcttcgtgagaaaggtcttcgcgacgtcgcgacgactttcaaggcgaaagaccgcaccatcggaaaaaataccatcgtcgtgatcgacgaaatgtcgatggccaagacgcaggagatcgcgcaactaatcgagacagttgcaaatgccacttcctatcacccaaccgaaaggccgaaactgatatgtgtgggagacgatcggcaactgccccctgttggacctggtgatctgcttccgattattatggagcaagccggctgctatgaactcgtccagccgcttcgacagctcgacgcgcggtcgcgaatagaaacagaaaagctcggacgtgacatacgacgcgatgccaagagcgccgtcgggcactatctcacagcgctcgaacaaatgggcctcgtccatttcgtatatgctcctcctagcggctcaaacgtcagggcgtcagaccagatcactgaccgcatgctggaggagatgaatagagtttgcgaccgatatccggtgtatgatcgtcttgtgatggcacactccaacaggagcgttaatcgcgccaatatcgctcttcatcagaggtttgttgacaaatccggattgcaagaccagcaaatgagtgtgtggtcaagcgtaatagatagtggaagttcggaatctggaatagatgagggttcgtcgagacgcgttcagcaaaggattaatctcgtcttgggagacaggattatattcagcgaaaaccgtctgcaagcggacatccgcaatggtacttttgcaactgtagtcggacttaatagcacagaagcttcccgagctgagaatggcacatctgctggggttcgcattactgcaaggttagacggatctggacgaaccgtcacttggaccgatagcgagtttaagggttttacctacggctatgctgctacaatttataagagtcagggggccacagttgatcacgccattctcctctgtgatggtgctctttcagataagctgacctatgtcggcctgacgaggcatcgcagtcgtctcgacgtcattgcttctcccctcgtggcaaacaatgttgaggctctcagtgcaaagctcactcagcaaagcgcgccaaataattccattcaattcccagcgctcgaacctgctgccttccaagagcgctcgtcggtttcgaacgcgcacttgctaaggccgctcgaccagatggaaatctctccaacgacgccgctttccttccaaggcagacaagaaagctccttcggggagaaccagctgcacgaaccatccacatcggatgtggaaatgccggaaagcgcggacctttacccgagcgccattgacttcgaagttttccagtcttctgtcatcacgactgaagagcaaatgcaaccggaattctgcgggtcggaatcgacggctaacacctcagcccacgaaagccaccaagtcacgatcgcaacggtaacaaacctggggatagcgatcgagaaacggaaacgagcggcggcaaaggaagaaatcgattctcgcaaaaaaatggcccgtcactcagttagttctgccgaggaagttgaagatatcacttccctgttcgaacgattgaaactggcaacctcggtcaccaacacagttcaaccgacgtatgcggacgtcgatcatatcatcggtactgatggccgagtgggtccaataccgcaccgggaagatgatccgggatcaaattgggaattgtcgtcaacgaacgccccctcaaacgtctcagagaaacgatcgaccaaagactcaggagaaaaaaatatggcttcgaatgaccagaaaatgcaaggcgctgactctgcaggcagcgagcgtcatttttcgcagacttccattgtggaagccctgcaggctggcgatcacaagaagctcgtggaaacgctcgccgcaaccggctcccttgtcgagaaggcggacgccgggtcggcgctgaaagcaatggcggatgcttacgaaagggatatcaaggcagatcccgaaaaggtccgcatgctctatgccaatcggcgcgttgatgtagatgcgctggccaaggagatcgaaaaacagggccttgcatccggtcgcctgagtggcgaccctgtcagcttcaaggcgttcaacaacaaggatatccgtttcagggtcggcgacaggctcagcgtcaccagcagctacaggaatctcattgccggtgaagccggccggatcgaaaagatcgaaggcaaatccgttaccttcaaacccgatggcagcagtcagagcaagaccttcgaggccagcaccggcgagccgggtgacaggggcgtcaagggctacaaaatcgaaggcccgatgacggtcatcggctccgcctatgaacttacgcgacatgatgacggcaaacgtgttgaccaaatctatctcttgaacgacgctgcccatggcatcaacgccaatagcgctttgctgagcaaggccgacgagcggacgcagcttttcacttcgctcaaggacaccgccgacagggacatcttggccaggcaactgggaaagccgggcagcgagctctaccaggacaaattcccagccttgccggactacacagccgccatcgatcggattgcaaaacgccaggaagttgtcgcggcacgtggcgaggagaaaacttccgccccgatagacctggcgccccaaacgccgcccgacgctgccgatgcggcagtcaataaccagaaaagaatcgtcgaggccttgcaggcaggcgaccacaagaagcttgtggaaacgctagccgcaaccggctcccttgttgagaacacaaatctcgtatcaacgttgaaagcgatagcgcagacttatgaaagagacattagtgcggaccccgagaaagtccgcgctctctacgccaacaaacgtgatcatgtagatttgcttgccgaagagatcgaaaagcagggccttgcatccggtcgcctgagtggcgaccctgtcagcttcaaggcgtttaacaacaaggatatccgtttcagggtcggtgacaggctcagcgtcactagcagctataggaatctcattgccggtgaagccggccggatcgaaaagatcgaaggcaaatccgttaccttcaaacccgatggcagcagtcagagcaagaccttcgaggccagcaccggcgagccgggtgacaggggtgtcaagggctataagattgaggggcccacgacaatcatcggctccgcctacgaaatcagaaatcacgacgatggcaggcgcgtcgatcaggtttatgtcttgcacagtgccattttcggctcaaatgccgcgagcgccctgttgagcaaggccgacgaacgaacccaggttttcaccgtgcaaagcgacacggctgacagacacatcttggccagccaactcagcaagcctggcagcgagctctatcaggacaaattcccagtctcgccggactacgcagccgcgatcgaccggatcgcgaaacgcgaggaacttagggccggacgtggcgaggaaagtcctactgttcaaatggagccggtgaaccaaacgccctacgaggcgggacattggacgcctgacagtcaaaaatctgtggtggaagccctgcaggctggcgatcacaagaagctcgtggaaacgctcgccgcaaccggctcccttgtcgagaaagcggacgccgggtcggcgctgaaagcaatggcggatgcttacgaaagggatatcaaggcagatcccgaaaaggtccgcatgctctatgccaatcggcgcgttgatgtagatgcgctggccaaggagatcgaaaaacagggccttgcatccggtcgcctgagtggcgaccctgtcagcttcaaggcgttcaacaacaaggatatccgtttcagggtcggcgacaggctcagcgtcaccagcagctacaggaatctcattgccggtgaagccggccggatcgaaaagatcgaaggcaaatccgttaccttcaaacccgatggcagcagtcagagcaagaccttcgaggccagcaccggcgagccgggtgacaggggcgtcaagggctacaaaatcgaaggcccgatgacggtcatcggctccgcctatgaacttacgcgacatgatgacggcaaacgtgttgaccaaatctatctcttgaacgacgctgcccatggcatcaacgccaatagcgctttgctgagcagggccgacgagcggacgcagcttttcacttcgctcaaggacaccgccgacagggacatcttggccaggcaactgggaaagccgggcagcgagctctaccaggacaaattcccagccttgccggactacacagccgccatcgatcggattgcaaaacgccaggaagttgtcgcggcacgtggcgaggtcaagccgattgagcgcaccgaagcgcccgaaataccccaggttcaagctactatcgttggcgagacctcgatcattcggttgcccgatcggataaaaaccaatcgcgagaagccccaagaacttgatgtagtctcgaaagaagggcacgaaactacaggtagtctgaggcagagtgtccaagagagtaatgcagcaccaaaacagacttcgccgaaggcggcaaatgacgtggatcggctgacacgggattttgacgagcgcatccgcgtccgcggggatggacgtggactctaagtaaaagagggtgcgtaacgcgcaccctcttccactcgctgtccctgtatccgttctctgtcgcgagaacgtcgatcaccttttcggaactctttccagatctgcttgaggttccgttgccggagaaagcattggcgaggattgctgggatccggcggacggcgatgcgatgtgccggttcggtgaccaattccatcagagaccggccgacgtatggcctgccgaagtggaaacggctgatcagcttgcgaggccgagctacttccccggcaagcgtcgggttcggggcattgttttcctcgaccatggcggtattttgctgagttgcccggctaaactaggctttggcagcctgttctttgaggtcatgccgtcactggcgatgtcatcgcgcgatccgcacgctcggcgacacgaaacggaaagcgaccaggcagggatgctgctgtcgtcgccgaagcactcgtcaatatccgaactcccttatgccgaaggcggcaaagcaggagttctaaaagaaagtgctataacgatcccgtcaacatcgaaagcagtaggccgttcgtcgcgcagacggccgatttgcatctgtttgcctggcgccgcctcaaagcggactatcgcccgccaatgtgcttttagctctccccgtcaatcctgaacttgacgctaaactgaactcaggccggtgctggttccatgctcattcgccagctcctggccaatcacaaccgcgctgccgtcattccggaaaaagcacacgtgtacctattcatcaagcgcggctctgccgccaggagccgtagcacgcgaattgatgtcaaatgaaaccaaactgtcaaaggcgggaatttgaatttcgacataaatatcagtactcataaattattaaagcacaaatttaatgttttccctcatattgcaaattctgaatgcggtttgataaagttattctacgaaccaatactatcatacgtcgaaagcgttagcacttttacttcgacgtttgttctttttgcaatgcgcgcggcgcagccaatgccgaatgaagcgtcttgatcatgagaccgtgtcgcgtcacccccgctggttttgaaagaagcgagatgcacatgcttatctatcttatctatggacccacctgtagcggaaaaaccgacttggcagtacaagtggcccgagaaacgggttggccggtaatagcgctcgatcgggtacaatgctgcccccaaatcgctaccggcagtggacgtcctttggaatcggaactgcaatccaccgagcgaatctacctggattcgcgcccactcgctgagggtgtgatcgatgcagaggcggctcatcgtcagctcatctcagaagtagagaatcgccggacctctcctggtctcatcctcgaaggcggttcgatttcccttctgaactgtatggccacggacacttattgggaagccgattttagatggcatgtaaggcgacttcgtcttgcggctccagatgttttcctgccgcgagcaagacgccgggtgacggaaatgtttgctgtcaaggacgagcgccgatctctgctgcaggaactgacggatctctggaagcaggaggcgctccggccgatactggaggacatcgacgggtatcgctgcgcaatccggttcgccaaggaacatgatatcgggattcgcgatttgttgcgtctcgatttgacgcgacagcaggcgctgatctcggccatcgccgacgaatattttgatcatgcgcagtggcaggagcgcgacttccctgattggcaggagggcggaaacgttcgcctcactcctcgggtggcatcaaacgctaactgagtgtcggaagttaacgtcgcgaaacgaagagatttgtgatgaccctaccggccaatcaatcgcctgaatggtcatattgtgcaacgaactcggggaggccaccggcactgctccaaaatccgagattcatcattccgataccccactgcatttggccttttcggtctacattttcaacggtgacaacaagctgctagtgacgcgccgggcatctgataagatcacctggcccggtgttctttccaacagttgctgtggacacccgcaacctggcgaaccgttgaccgaggctatcgagcgccggggtcacgaggaattgcggatacgtgcagacgacattcgtcttgtgctgccggaattttcctatcgcgcttcaatgacgaatgggatcaccgaaaacgagttgtgccccgtattcgctgcacattgcaaaacctccggcgtcaaccccgatttgaatgaggtgtcagcgtgggaatgggtgcattggcaatggtttttcgaaagcgtacaggctgagcgcttgttggtgtcaccatggtgtcgtgcacaagtcgacctgctcgcaccacttggtgcgaacccatcgcaatggcccgtagcggaggagcggcggctaccaaaagctgccagaacgaagattgacgttcaacttaaggtttcttagctaagccgctcccgggcgtggagctcgtagggagtttctcaattcgggaaatagctggccttcaagaagttcgttttctcaattggaggagcgtttgagatattgcgtctttgcgggttcaagcaacggccaaaatccggcctatgtgagcgcagcaaaccaacttggcaaagctctggcgagatcgggcatcggattggtgtacggcggcgcttcgattggtttaatgggtgctattgcggacgcggcccgaagcgatggcggagaggttatcggcgtcattccccgcgcgctggccgagaaggagatcgcacacaccgatcttgctgatctacgcgttgtcgagaccatgcacgagcgcaaagcgctgatgacgacgctgccggatggttttatcgctttaccaggaggattgggaaccctcgaagagctgttcgaagtatggacatgggctcagttgggttaccacaataagccctgtgcactgctggacgtagcgggcttttacaaaaggctagattcctttcttgatcatattgttggcgaagcattcttgacagcaagtcatcgcaacatcctcctcgtcgaagaggacgccgaggtgctcatttctgccatggcaaaagatagtgccacttgaaagttacgttcagaagagagcgattttaggctactccgacgctaactgcgcgctttgcaggttacctgaaacgtgttgtccaaaaagcgagatggcactacgagcgctggtcccccctgtgttggctctgtttattttgtaacgaaattgctgtggcaaaccgtagccgatttcatatttcttgtttctcgcggaatgtcgggctgaaaaacgttcatcaagaggactgatgcgataggccacaggggggcgatgcatgagaaggacgtcggatgaggctgcagctacccggaggcggattttacgctctgccgaggctgtgtttatcgaaaaaggatacgatgaagcctccttgcaggaaattgccgccgaagcggccgtaacaaccggcgccatccagtggcatttcggacaaaaaaatgcacattctactggccttgcgcgatgagttatgctggcaggcaagaaagctcggcagccttcacgacgcagggatggttgaggagccattaaaggcagtcgccgagtttgccacatcagccattaaccactttgctgacaatgaaaactgcaggcggattttccagatctatgataagaaagtctccgatacagtggccttccataatgaagaccgcaagtttcagcaggaagtgcgggctacgttagggagcgttttcggatccgcagagacgagaaaggaattactagctccttggacctccgacactgcggcatataccttttggtttgcaatgcgaggaacgtttcagacctggctggaggatgattcgaggtttgacctgaagtccgatggcatgcgtatcgttcaaacgatgctttcctcgtaccagcgcgccgatttggtcactggataa

SEQ ID NO: 128 - protein, 262 aa, Agrobacterium strain K599 (NCPPB 2659)
MGKLSLLAPGESAIAIENKAALGKFVIVCEHASHLIPPSLGDLGLDASARSSHIAWDPGALELARYLSSSLDAVLYYQRFSRLVYDCNRPPEAVSAIVGKSEIYDVPGNQSMPEADRLTRINEIYLPFRDGLSEILASRKAQGRGTMLVTVHSFTPVYFGKKREVEIGILHDSDTTLADAILAEFEGADRKYVVMRNQPYGPADGVTHTLVEHGIANGIPNVMIEVRNDLLVAADDQAAVGSYLSRLIGKAASTVKAGQTVS

SEQ ID NO: 129 - protein, 463 aa, Agrobacterium strain K599 (NCPPB 2659)
MYSIILGRERHVFADLKSVMACASPLKSGDVLAGVAASSNERRVAARCLLADMPLKTFLEDLLIPYEVDEVSRLIIDRHDPIAFAPVSHMTVGEFRNWLLSYDATTERLAALATGLTPEMVAAVSKIMRNHDLITVAGKCNVVTAFRSTIGLPGRLSSRLQPNHPTDDPEGVAGSTLDGLLYGIGDAVIGINPATDNLDACTRLMVLFDRLRERFEIPTQSCVLTHVTTSIKAIEAGAPLDLVFQSIAGTEAANNGFGVDLAVLREGNDAALSMKRGSVGNNVMYLETGQGSALSADAHHGVDEQTVEVRAYAVARELRPLLVNTVVGFIGPEYLFDAKQIIRAGLEDHFCGKLLGVPMGVDVCYTNHAEADQDDMDNLMVLLTVAGVSFMIAVPGADDVMLNYQSLSYHDIVGLRHQFNRPPAPEFEAWLNRMGMLDHSGRLAPASASGQFSRNLLSYGVSA

SEQ ID NO: 130 - protein, 1769 aa, Agrobacterium strain K599 (NCPPB 2659)
MPTDDIVMSDPGMAAVDTSVPTRFQTDLRQFSNLLDESNIVEWVVNHAANRNACFGQDQLKISAARALTHYKRPVQEIDLLFQQVVASDKLTRLDSPDGQPLYTSTELRAAEQNTVRHVTNLSAEESFGVPGTIVDMVADRGIFTPELRGALHYLSRRNRASTMVGVAGSAKTSVLGALNEAVDRFNEEALPTEKIKLIAFVPTNRAAQELREKGLRDVATTFKAKDRTIGKNTIVVIDEMSMAKTQEIAQLIETVANATSYHPTERPKLICVGDDRQLPPVGPGDLLPIIMEQAGCYELVQPLRQLDARSRIETEKLGRDIRRDAKSAVGHYLTALEQMGLVHFVYAPPSGSNVRASDQITDRMLEEMNRVCDRYPVYDRLVMAHSNRSVNRANIALHQRFVDKSGLQDQQMSVWSSVIDSGSSESGIDEGSSRRVQQRINLVLGDRIIFSENRLQADIRNGTFATVVGLNSTEASRAENGTSAGVRITARLDGSGRTVTWTDSEFKGFTYGYAATIYKSQGATVDHAILLCDGALSDKLTYVGLTRHRSRLDVIASPLVANNVEALSAKLTQQSAPNNSIQFPALEPAAFQERSSVSNAHLLRPLDQMEISPTTPLSFQGRQESSFGENQLHEPSTSDVEMPESADLYPSAIDFEVFQSSVITTEEQMQPEFCGSESTANTSAHESHQVTIATVTNLGIAIEKRKRAAAKEEIDSRKKMARHSVSSAEEVEDITSLFERLKLATSVTNTVQPTYADVDHIIGTDGRVGPIPHREDDPGSNWELSSTNAPSNVSEKRSTKDSGEKNMASNDQKMQGADSAGSERHFSQTSIVEALQAGDHKKLVETLAATGSLVEKADAGSALKAMADAYERDIKADPEKVRMLYANRRVDVDALAKEIEKQGLASGRLSGDPVSFKAFNNKDIRFRVGDRLSVTSSYRNLIAGEAGRIEKIEGKSVTFKPDGSSQSKTFEASTGEPGDRGVKGYKIEGPMTVIGSAYELTRHDDGKRVDQIYLLNDAAHGINANSALLSKADERTQLFTSLKDTADRDILARQLGKPGSELYQDKFPALPDYTAAIDRIAKRQEVVAARGEEKTSAPIDLAPQTPPDAADAAVNNQKRIVEALQAGDHKKLVETLAATGSLVENTNLVSTLKAIAQTYERDISADPEKVRALYANKRDHVDLLAEEIEKQGLASGRLSGDPVSFKAFNNKDIRFRVGDRLSVTSSYRNLIAGEAGRIEKIEGKSVTFKPDGSSQSKTFEASTGEPGDRGVKGYKIEGPTTIIGSAYEIRNHDDGRRVDQVYVLHSAIFGSNAASALLSKADERTQVFTVQSDTADRHILASQLSKPGSELYQDKFPVSPDYAAAIDRIAKREELRAGRGEESPTVQMEPVNQTPYEAGHWTPDSQKSVVEALQAGDHKKLVETLAATGSLVEKADAGSALKAMADAYERDIKADPEKVRMLYANRRVDVDALAKEIEKQGLASGRLSGDPVSFKAFNNKDIRFRVGDRLSVTSSYRNLIAGEAGRIEKIEGKSVTFKPDGSSQSKTFEASTGEPGDRGVKGYKIEGPMTVIGSAYELTRHDDGKRVDQIYLLNDAAHGINANSALLSRADERTQLFTSLKDTADRDILARQLGKPGSELYQDKFPALPDYTAAIDRIAKRQEVVAARGEVKPIERTEAPEIPQVQATIVGETSIIRLPDRIKTNREKPQELDVVSKEGHETTGSLRQSVQESNAAPKQTSPKAANDVDRLTRDFDERIRVRGDGRGL

SEQ ID NO: 131 - protein, 259 aa, Agrobacterium strain K599 (NCPPB 2659)
MRPCRVTPAGFERSEMHMLIYLIYGPTCSGKTDLAVQVARETGWPVIALDRVQCCPQIATGSGRPLESELQSTERIYLDSRPLAEGVIDAEAAHRQLISEVENRRTSPGLILEGGSISLLNCMATDTYWEADFRWHVRRLRLAAPDVFLPRARRRVTEMFAVKDERRSLLQELTDLWKQEALRPILEDIDGYRCAIRFAKEHDIGIRDLLRLDLTRQQALISAIADEYFDHAQWQERDFPDWQEGGNVRLTPRVASNAN

SEQ ID NO: 132 - protein, 199 aa, Agrobacterium strain K599 (NCPPB 2659)
MVILCNELGEATGTAPKSEIHHSDTPLHLAFSVYIFNGDNKLLVTRRASDKITWPGVLSNSCCGHPQPGEPLTEAIERRGHEELRIRADDIRLVLPEFSYRASMTNGITENELCPVFAAHCKTSGVNPDLNEVSAWEWVHWQWFFESVQAERLLVSPWCRAQVDLLAPLGANPSQWPVAEERRLPKAARTKIDVQLKVS

SEQ ID NO: 133 - protein, 137 aa, Agrobacterium strain K599 (NCPPB 2659)
MGAIADAARSDGGEVIGVIPRALAEKEIAHTDLADLRVVETMHERKALMTTLPDGFIALPGGLGTLEELFEVWTWAQLGYHNKPCALLDVAGFYKRLDSFLDHIVGEAFLTASHRNILLVEEDAEVLISAMAKDSAT

SEQ ID NO: 134 - protein, 152 aa, Agrobacterium strain K599 (NCPPB 2659)
MHILLALRDELCWQARKLGSLHDAGMVEEPLKAVAEFATSAINHFADNENCRRIFQIYDKKVSDTVAFHNEDRKFQQEVRATLGSVFGSAETRKELLAPWTSDTAAYTFWFAMRGTFQTWLEDDSRFDLKSDGMRIVQTMLSSYQRADLVTG

SEQ ID NO: 135 - DNA, 1833 bp, Agrobacterium strain K599 (NCPPB 2659)
  CDS (1)..(669): rcorf43, similar to riorf73 in pRI1724, similar to SMa2002 [Sinorhizobium meliloti 1021], COG2755 [E] Lysophospholipase L1 and related esterases.
  CDS (715)..(1833): rcorf42, similar to riorf73 in pRi1724, hypothetical repressor gene, similar to SMa2004 [Sinorhizobium meliloti 1021], putative ROK-family transcriptional regulator.
atgatttgccataaaggtggggaggaaatgcggtcagtcttatgttacggcgactcgaatacgcatggccagattccgggcggctcgccgctcgatcgatatgggccggacgagcgctggccaggcgttttgagacgggagcttggaagcaagtggtatgtggtcgaggagggcttgagcggccgtacgacggttcgagacgatccgatcgaaggcccgatgaagaatggccgaacctacctccggccatgcctcatgagccacgcaatcctcgatctcgtcatcatcatgctcgggacgaacgacctgaaagcccgtttccaccagcctccctccgaagtggcgatggggattggctgcctggtctacgatatccgggagctggcgcccggtccggccggcaagccccccgaaatcatggtggttgctccaccgccgatgctggacgatatcaaggaatgggaacccatatttttcggcgcccaggagaaatcccggcgtctcgccctcgaattcgaaatcattgccgattcgctcgaagtacatttttttgacgccgccaccgtcgcggcttgcgatccgcgcgatggctttcacatcaatcgggaagcgcatgaagccttgggaacggcgctcgccagggaagtcgaggcgatcggttggagatgatgatattgccgcagcgacgttacgaatggatgccagtacatctttatgccttactccaagaggattgcattgatgcctgatatgcgttttgcaccacccaatcccttgcgtattgccgatcgggcaaccggcctgaatgcggtcagcgtgcgcagttacaatgagcgcctgctgctgtcgctgttgcttcagaacagcgagatcacccgattggagatcggcgaacggacgggcctttcagcccagactatttcggtgctggtcaggtcgctggagcaggaaggactggttgcgaagggggaagcccagaagggacgggtcgggcctccgaccgttccggttgccctcaatccggaaggggccttttcgatcggcatcagtgtcggcctgaagcgtaccgacgtcgttctgatcgattttgccggcgccgttcgctatcatatgcaattgcctaatccgcagcccgaacgcgacagcaaccagacaatgttcatcgagaccattcgtcaggcggtgaacatcgtccccaagaatgctcaaaagcgtctagccggcattggccttgcgcttccgtcgagcgcttcggaggggcgtgaggaaaaggcctacttcgactcgctccagaaggaagtcgaggagcttaccggctactcggtgttcgtgcagaacgacattacggctgcggccagcggcgaaagcatgttcggtgtcgccaagccgttttccgattatctctacttttatatcggcgcgaacctccacagccgcctggtcttgaaccaccagatccaccacggcaattcggtggtcagtttcgatgtcggcgtggcatctttggaatccgtattgaccgccgtgggcgcgccaacggatcacctgtggcagccgctcgcaccatggccggagaacagtctggttctcgaatgggaaggcaaactggcggaaaagatgcagggcatcgtcaagtcgctcgcgcaatttgtcgagctcgaagcggtgatcgtttcttcattcgtgccgaatgtcgtctatcggaacatctgcgtctcgctgcaaaagctggttcccgaagtgaccgtgatgccgagcggcatattgaacacgccgaaggccgtcggtgctgcaagcctgccattcatctcccgtttcatggtggaaagttga

SEQ ID NO: 136 - protein, 222 aa, Agrobacterium strain K599 (NCPPB 2659)
MICHKGGEEMRSVLCYGDSNTHGQIPGGSPLDRYGPDERWPGVLRRELGSKWYVVEEGLSGRTTVRDDPIEGPMKNGRTYLRPCLMSHAILDLVIIMLGTNDLKARFHQPPSEVAMGIGCLVYDIRELAPGPAGKPPEIMVVAPPPMLDDIKEWEPIFFGAQEKSRRLALEFEIIADSLEVHFFDAATVAACDPRDGFHINREAHEALGTALAREVEAIGWR

SEQ ID NO: 137 - protein, 372 aa, Agrobacterium strain K599 (NCPPB 2659)
MPYSKRIALMPDMRFAPPNPLRIADRATGLNAVSVRSYNERLLLSLLLQNSEITRLEIGERTGLSAQTISVLVRSLEQEGLVAKGEAQKGRVGPPTVPVALNPEGAFSIGISVGLKRTDVVLIDFAGAVRYHMQLPNPQPERDSNQTMFIETIRQAVNIVPKNAQKRLAGIGLALPSSASEGREEKAYFDSLQKEVEELTGYSVFVQNDITAAASGESMFGVAKPFSDYLYFYIGANLHSRLVLNHQIHHGNSVVSFDVGVASLESVLTAVGAPTDHLWQPLAPWPENSLVLEWEGKLAEKMQGIVKSLAQFVELEAVIVSSFVPNVVYRNICVSLQKLVPEVTVMPSGILNTPKAVGAASLPFISRFMVES

SEQ ID NO: 138 - DNA, 2519 bp, Agrobacterium strain K599 (NCPPB 2659)
  CDS (1)..(294): rcorf76, probable traC gene, Ti plasmid conjugal DNA processing, similar to riorf111 in pRi1724
  misc_feature (314)..(529): rcorf75, probable traD gene, conjugal transfer protein.
  CDS (516)..(2519): rcorf74, probable traG gene, similar to riorf109 in pRi1724, a cd01126: TraG_VirD4; The TraG/TraD/VirD4 family are bacterial conjugation proteins.
atgaaaaaacctgcctcgaaaatccgcgacgaaatcgccaagttgcaggagcagctcaaggtcgccgagacaagagaagccgagcggatcggccggatcgcgctcaaggccggccttggcgagatcgagattgaggaaggggagctgcaggccgctttcgaggaagtggcgacgcggtttcgcggaggccaagggggagggaagggcgctacgaacggagggaaaaagggtgccggcgatagcagcggcgcaacgtcgacgccggcggactcctctggtgcgggcgcgggcagcactggcgaggcttgagcgtatggcgaggacgatgacatccgacgcccgcaagaaggaaacgcgggaaaagatcgagctcggcggcctgatcgtcaaggccgggctgcgttacgagaagcgcgcgctgttgctgggcgcgctgatcgatgtcgcccgccgaatcaagggtgatgagggcgagcgatccaggctcacggcaatcggcgcggaggcctttggcaatgacgatcaataggattgcgctcgtcgtcgggccggcggcgctgatgatcctggtcgtcatcgggatgacggggatcgagcagtggatttccggcttcgggaagaccgaggccgcacgcttggcatgggggcgtgcgggcatcgcgctgccctatgtcgccagcgcggcgatcggtatcgtgttcttgttcgcaagtgccggcgcgatcagcatcaagcaggcaggctggggcgtcgttgcgggatgcagtggaacgatcctgatcgcggctacccgcgaaaccatacgccttgccgctttcacgaagacgctgccaaccggcaagacggtcttcgcctatctcgatccggcaacgtcgattggagtaggcgcagcgttcatgtgtgcctgcttcgcactccgcgttgcgttcatcggcaatgcggcattcgcaagggccgagccaaagcgcattcagggcaagagggcactgcatggcgaagccgactggatgaagccgccagaggcggcgaagctgttttccgattccggcggcatcgtcatcggcgagcgctatcgggtcgacaaggacagcgtcgcggcattggcatttcgagccgatagcgcggagacctggggcgccggcggcaagtcgccgttgctgtgcttcgatggctcattcggctcgtcgcacgggatcgtctttgcggggtccggtggtttcaagacgacgtcggtgaccatcccgacggcactcaaatggggcggcacgctgatcgtgctcgatccgtcgaacgaggtcgccccgatggtctccgcgcatcgcggcggagcgggaagggacgtgttcgtcctcgacccgaggaagtcggacatgggcttcaacgtgctggactgggtcggccgtttcggcggaacgaaggaagaggatattgcctctgtcgcatcgtggatcatgagcgacagcggcggcgcgcgcggtgtccgtgacgacttctttcgcgcgtcagccctgcagttgctcaccgcgctcatcgccgatgtctgcctgtccggtcacatggacgagaaggaccagacgcttcgccgggtgcgcatgaacctgtcggagccggaaccgaccttgcgcaagcgcctgcaggacatctacgacaattcgggttcggatttcgtgaaggagaacgtcgctgccttcgtcaatatgacgccggaaaccttctccggcgtctatgccaatgcggtcaaggaaacgcattggctttcctatccgaattatgccgccctggtgtccggacggaaattctcgaccagcgacatcgccgcgggaaataccgacgtcttcatcaacatcgacctcaagacgttggagactcattccggtcttgcgcgtgtcgtcatcggctcgcttctcaacgcgatctataatcgcgacggaaagcttgaagggcgcgcgctgtttcttctcgatgaggtcgcccgcctcggttacatgcggatcctcgagactgcgcgcgacgccggccgcaaatacggaatcacgctgacgatgatctatcagtcgatcggccagatgcgcgaaacctatggcggccgcgacgcggcaagcaagtggttcgagagtgccagctggatctcgttcgccgcaattaacgatcccgagaccgccgactacatctcgaaacgttgcggcatgaccacggtcgagatcgaccaggtcagccgcagttcccaggcaaggggatcatcgcgaacacgctcgaagcagcttgccgccagaccgcttatccagccgcatgaggttctgcgcatgcgggccgacgagcagatcgtgttcacggccggcaatgcaccgctcagatgcgggcgcgccatctggttccggcgcaacgatatgagagcctgcgtcggcgagaaccggtttcattcgatgggcggaagggagaaggaaggttcgaattcggcgtctgcggtaaacgcctatgaaaccaaaccggctgtaacctctgccgccgaagaggaatga

SEQ ID NO: 139 - protein, 98 aa, Agrobacterium strain K599 (NCPPB 2659)
MKKPASKIRDEIAKLQEQLKVAETREAERIGRIALKAGLGEIEIEEGELQAAFEEVATRFRGGQGGGKGATNGGKKGAGDSSGATSTPADSSGAGAGS

SEQ ID NO: 140 - protein, 667 aa, Agrobacterium strain K599 (NCPPB 2659)
MTINRIALVVGPAALMILVVIGMTGIEQWISGFGKTEAARLAWGRAGIALPYVASAAIGIVFLFASAGAISIKQAGWGVVAGCSGTILIAATRETIRLAAFTKTLPTGKTVFAYLDPATSIGVGAAFMCACFALRVAFIGNAAFARAEPKRIQGKRALHGEADWMKPPEAAKLFSDSGGIVIGERYRVDKDSVAALAFRADSAETWGAGGKSPLLCFDGSFGSSHGIVFAGSGGFKTTSVTIPTALKWGGTLIVLDPSNEVAPMVSAHRGGAGRDVFVLDPRKSDMGFNVLDWVGRFGGTKEEDIASVASWIMSDSGGARGVRDDFFRASALQLLTALIADVCLSGHMDEKDQTLRRVRMNLSEPEPTLRKRLQDIYDNSGSDFVKENVAAFVNMTPETFSGVYANAVKETHWLSYPNYAALVSGRKFSTSDIAAGNTDVFINIDLKTLETHSGLARVVIGSLLNAIYNRDGKLEGRALFLLDEVARLGYMRILETARDAGRKYGITLTMIYQSIGQMRETYGGRDAASKWFESASWISFAAINDPETADYISKRCGMTTVEIDQVSRSSQARGSSRTRSKQLAARPLIQPHEVLRMRADEQIVFTAGNAPLRCGRAIWFRRNDMRACVGENRFHSMGGREKEGSNSASAVNAYETKPAVTSAAEEE

SEQ ID NO: 141 - DNA, 11199 bp, Agrobacterium strain K599 (NCPPB 2659)
  CDS (1)..(624): rcorf95, probable traI gene similar to riorf131 in pRi1724, a LuxI-type quorum sensing regulators, synthesizes 3-oxooctanoylhomoserine lactone, a pfam00765: Autoind_synth; Autoinducer synthetase.
  CDS (736)..(1125): rcorf94, probable trbB gene similar to riorf130 in pRi1724, Type IV transfer system required for Ri/Ti plasmid conjugation
  CDS (1600)..(1983): rcorf93, probable trbC gene similar to riorf129 in pRi1724, Type IV transfer system required for Ri/Ti plasmid conjugation
  misc_feature (1976)..(2275): rcorf92, probable trbD gene similar to riorf128 in pRi1724, Type IV transfer system required for Ri/Ti plasmid conjugation
  CDS (2286)..(4742): rcorf91, probable trbE gene similar to riorf127 in pRi1724, Type IV transfer system required for Ri/Ti plasmid conjugation
  misc_feature (4666)..(5517): rcorf90, probable trbJ gene similar to riorf126 in pRi1724, Type IV transfer system required for Ri/Ti plasmid conjugation, COG5314; Conjugal transfer/entry exclusion protein [Intracellular trafficking and secretion]
  CDS (5514)..(5630): rcorf89, trbK gene homolog similar to riorf125 in pRi1724, Type IV transfer system required for Ri/Ti plasmid conjugation
  CDS (5708)..(6889): rcorf88, probable trbF gene similar to riorf123 in pRi1724, Type IV transfer system required for Ri/Ti plasmid conjugation
  CDS (6910)..(7572): rcorf87, probable trbF gene similar to riorf123 in pRi1724, Type IV transfer system required for Ri/Ti plasmid conjugation
  CDS (7589)..(8401): rcorf86, probable trbG gene similar to riorf122 in pRi1724, Type IV transfer system required for Ri/Ti plasmid conjugation
  CDS (8405)..(8845): rcorf85, probable trbH gene similar to riorf121 in pRi1724, Type IV transfer system required for Ri/Ti plasmid conjugation
  CDS (8857)..(10149): rcorf84, probable trbI gene similar to riorf120 in pRi1724, a pfam03743: TrbI; Bacterial conjugation TrbI-like protein
  CDS (10525)..(11199): rcorf83, probable traR gene similar to riorf119 in pRi1724 and traR/AGR pTi 249 in pTiC58
atgcaggttctcgcgatctcaacaccgaaaaatattcaggaagctgagcttatccaccgccatcacgagctacgcgcgcgggtcttcgccgaccggctaggctgggatgtcgaagttatcgacggcgtggaattggatgctttcgacactctgataccgacttacatcctcgcaatttccgacagtcgccaggtagcaggatgcgcgcggctgcttccggcgcctggccccacaatggtggccgacgtctttcactcactccttccgaatggccggttgaacgcccattccgcgatgatcgagagctcccgtttttgcgtcgatacggcgctcggcgagggcaggggagacggatccgtccatgaggcgacgctgaccatgttcgccggcatcatcgaatggtgcatgtcgaacggtttcaccgaaatcgtcaccgtcactgacctgcgtttcgagcggatcctcgcgcgcgtcgggtggccccttcagcgcttgggcgagcccaggaagttcggggtgacgatggcggtcgcgggaatcctactcgccgacgccagtacatttcaaaagctccgtcccgccaactatcgctctgaattcacctccctcagcaaggcagcgtaggagaaatccgtgaaccagcttcgctctcaccctcggcttgtgcgtaaacttcaggaagcactcggtgaccagctctgcgtggcgctggacgatgcaacagtcgtcgagatcatgctcaatccggatggaaagctgtttatcgaacgcctcggacatggcgttgcgcccgccggcgaaatgtccccggccgcggccgaaatggtgatcggtactgtcgcgcatgcactgcagtcggaggtcgataccgaacagccgatcatctccggagagctgccgatcggcggtcaccgcttcgagggactgttgcctcccgtggtcgccaggcctgctttcacgatccggcgcagggcatcgcgcctcatcccgctcgaagattacgtccggaccggagtgatgaccgaataccaggccgcgacgatccgcagcgcgatttccgcgaggctcaacatcatcatttccggggaacgggctcgggcaagacgacgcttgcgaatgctgtgatcgacgagatcgtgaaaagcgcgccagaagatcggctcgtcattctggaagacaccgccgaaattcaatgcactgccgagaacgcagttctgctccataccagcgatacgatcgacatggcacggcttctaaagagcacgatgcgcctgcgtcctgatcggatagttgtgggcgaggtccgcgacggcgctgccctgaccctgctcaaggcttggaacaccggtcatccgggcggcgtggcgaccatccactcgaacaccgccatgtcggcgctgcgccgtcttgaacagctgacggccgaggcaagccagcagccgatgcaagaggtgatcggggaagccgtcgatctcgtgatctccattgagcggacgccgcgcggacggcgcgttcgcgacgtcatccaggtcgagcggttcgtcaacggtcaatacgaggtcgaatccgatcagctcacagaagaacaggaagcgcgccatgtcgcataggaaatcattcatcgccgtcgcgctcttggcggcgcccatcgttctcgcctcggtcgcgccgacccttgccagctccggcggcagtctcccgtgggaagggccgctgcagcagatccaggagtcgatcaccggcccggtcgcgggtgcgatcgcgcttgcagcagtcgccatcgccggcggcatgctcatcttcggcggcgaactgaatgatttcgcgcggcgacttgtatacgtcgttctcgtcgccggcatcctcctcggcgccaccaacatcgtcggcctgtttggcgcaaccggcgcctcgataggactgacgagcgaacagctcaccacgattggatcggccggaggcggggagggaactcatggctaattccccatccggcctgcagcgcaaccgcatccaccgtgcactgtcgcgtccaaacctgctgatgggcgccgacagggagcttgtgttgctgaccggtctcgccgccgtcatcctgatcttcgtggtgctgacggtttattcggcgctcttcggaatcgccgtctgggtcgtgatcgtcgggctcctcagaatgatggcgaagtccgacccgttcatgcggcaagtctatatcaggcacatttcctacaagcccacctacaaggcgacgacatcgccttggcgccggtattgaggaggcggccatggtagctctcaaacgcttccgggcgaccggcccttcctttgctgatctcgttccctatgccggcctggtcgacaatggtgtcctcctcttgaaggacggaagcctgatggccggctggtatttcgcgggaccagattccgaaagtgcgactgacctcgaacgcaacgacctgtcgaggcagatcaacgccgttctgtcgcggcttggaagcggctggatgatccaggtcgacgccattcgcattccgacggtcgactatcccacagaagaccgttgccatttccccgatccggtaacccgcgcaatcgacggggagcgccgggcgcatttcgcgcgcgagcaggggcatttcgagagcaagcatgcgctgatcctgacttaccggccgctcgagtccaagaaaacagctctcagcaagtacatctattcggacgaggagagccggaagaaatcctacgcggacacggtgctcttcgtgttcaagaacgcggtgcgagagcttgagcagtattttgccaacacactttcgatccggcgaatggaaacccgagaaacggtcggaaggggaggggagcgaattgcccgatatgacgaactgcttcagttcgcccgcttctgcattaccggcgagaaccatccaatcaggcttcccgatgttccgatgtatctcgactggatcgccacggcggagcttgaacacggactgacgccgaaggtcgaaaatcgctttctcggcgtcgtcgcgatcgacggtctgccggctgaaagctggccgggcattctgaatagtcttgacctgatgccgctcacctatcggtggtcatcacgtttcatcttccttgatgccgaggaggcccgacagaagctcgaacgcacacgcaggaaatggcagcagaaggtccggccgttcttcgaccagatatttcagacacaaagtcgatccgtcgaccaagacgcgatgaccatggtcgccgagaccgaggacgccatcgcgcaggcctcatcgcagctggttgcctatggatattacacaccggtcgtcgtgctattcgacaacgatcgcgaagccctgcaggagaaggccgaagcgatccggcggctgatccaggcggaagggtttggggcgcggatcgaaacgctgaacgccaccgatgcctatctcggcagcctgccgggcaactggtactgcaacatccgtgagccactgatcaacaccagcaatctcgccgacttgattccgctgaattcggtctgggccggaaacccgatcgcgccatgccccttttacccaccgaattcccctcccttgatgcaggttgcgaccggctcgacagcgttccgtctgaacctgcatgtcgatgatgtcggccacacgttgatcttcggtccgacaggttctggtaagtcgacgctgcttgctctgatcgccgcacagtttcgccggtacgaaaatgcgcagatcttcgcctttgacaaaggcagttcacttcttcccctgacgctcgctgccggtggtgatcactatgagatcggcggcgacaatgcggaagaggggagggccttggccttctgcccgctttctgatctcgaaagtgatgccaaccgggcctgggcgaccgagtggatcgagatgctggtcggtctgcagggcgtcacaatcacccccgatcatcgtaacgccatttctcggcaggtcggactgatggcgagcgcatccggtcgctcactctcggatttcgtcagcggcgtgcagctgcgcgagatcaaggatgcgctgcatcactacaccgttgacgggccgatgggccagctcctcgatgcggaggaggacggcctgacactcggggccttccagaccttcgaaatcgagcagctgatgaacatgggcgagcgcaatctcgtgccggtgctgacctacttgttccggcggattgagaagcgtctggatggatcgccgagcctgatcgtgctcgatgaggcgtggctgatgcttggccacccagttttccgcagcaagatcagggaatggctcaaggtcttgcgcaaggcgaactgcgccgttgtccttgcgacccaatcgatctcggatgccgaacggtccgggattatcgatgtgctgaaggagtcttgcccaaccaagatttgccttccgaatggcgccgccagagagccaggaacacgtgaattttacgagcgtatcggtttcaacgagcgccagattgagatcgtctcgaacgcagtccccaaacgcgaatactacgtcgccacgccggaaggccggcggctcttcgacatgtcgctggggccggttgcgctgagctttgtcggcgcgtcgggcaaggacgacctcaagcgcatccgcgcactgaaatccggacatggccgcgagtggccaatccgctggcttgaaacgagaggagttcacgatgccgcatcgctactcaagttcgaatagatggttagcctgcctggcggccgcggccctgacgatcggagccgtaccttcagcacgggcggggaccgccaccggtgctgcgacggagtggacgcagctcgccaacaatgcgcaattggtggaccttctcaagagctcgggcctccaggtcgacaatcagctgacgcagatcagccagcttgcggagcagatccagaaccagcttaagatctaccaaaacatgctgcaaaacaccgcgcagctgcctgaccatgtctgggggcaggtcgaaagcgatctcaatcagctccgcagtattgtcgaccagggtcagagtatctcattctccatgggcaacgccgacgacgttcttcagcagcgctttcagagctacgccgacctcaaaaccaacctgccggataacgcgacgttctcctcgacttatcagtcctggtcgacgaccaaccgcgacacgatcgccagctcgctgaaggctgcgagcctaacggccgaccagttcgatagcgaggaagatacgatgtcctcgctgcggtcgatgtccgaaacggcggacgggcagatgaaagcgttgcaggtcggccacgagatcgccgctcagcaggttgcccagatgcagaagcttcgcggtctcgtctcgcaacagatgacgatgatgggaacctggctacagacggagcagaccgacaaggacctggcgcaggcccggcgggaaaagttcttcaacgctgaggtcaagagcattccggaaggtcagagaatggagccacgctggtgagccgatccgtcctaattgctttggtgcttgctgtcgccgctgcatccgccgcggccacagtgctgatcgtaaaatccagcgacggcggaagacctgcgcttaccgaggagcagcgctcagcccgggagaagttcttcggctcgaataaggagctgccgccgatcaaggatggtcaggagatacggccgagatggtgaagcccgctgtcacacgttcactcctgataactggtctgttcttcctcgcctatgctgctcccgcatttgcgcaggaggggcaggtcctcacggaactggaaaaccaggtctcctctgccgcgaagggctgggagaccaccatcatggatgcggcgaaatcgctgttctggatcctcgcaacgatcgagatcggcattgccgccgtctggctggcgatccagtcagcctcgctggatagctggtttgcggagctggtgcgccggatcatgttcgtcgggttcttcgcattcgttctgacccaaggtccgacctttgcccgggcggtggttgacagtcttttccaaattggtgccggcggcggttcagcctcgcccgctgaagtgttcgatgccggcattcgcgtcgcctcgcaaatgtcgcaacaggcgcagttcggcgtattcgaggacaatgcgctggcgattgccgcggtgctggcaatgggtgtcgtcgtcatctgcttttcgctggttgccgcgatttttgtttcggtgatggttgagatgtatgtcggcctgctcgccggcatgatcatgcttggcctgggcggttcctccttcaccaaagactttgctgttcgctatcttgtctacgccttcggcgttggcatgaaactgatggcgctggtgatgatcgcaaagattgggtcacaggtcctcttgggtctggccaatgccccgaccgcatcctccgaccagtttgtcaccaccctggcgatcgccggtatttccgtcgtggtcttcatcatcgccatgtacgtgccgaacatcatccagggtgtcgtccagggagcctccgtcaccggcggtatggagacaatccgccacggcgggcaagcggcgtccttcgccgcgggcgctggattcttggccgccggcgctgccggcgcgggttttgcggcggcccaagccgcacgagctggcggttcatccgtcgctggtgctgccctgcgggggataggcgcaagcttcagttccggggcacaagccgcaggctcggccgcgaaggaaaaggcaatcggatctcccggtgcttatgcggggtccatcctcggactagccaacgccaagctcgatgaacagcgcagcggtcacagcggcccgacgcctcctcccgaacgcaacgacaaaccataatcgagacaagggaagaataaatggcagcgaaccgcgcccctgataatccgtatcttgccgcccgccaggaatggaacgagcgctacggcacatatgtgaaggctgcttccgcatggcggatcgtcggcattctcggcctgacgatggccgtcatcggcttcagctacgcgatgtatctcagtacccaggtcaagctcgtgccttatatcgttgaggtcgacaagctggggacggcagtcacggcaggcttcccggagcagatcgaatatgccgatgtccgcgtggttcgcgccacactcggcaacttcgtgacaagctttcgctcgatcacgccggatgccgtggtgcagaagcaatatatcgaccgcacatacgctcttcttcgcacctccgatccgtcgacggagaaggtcaacgcctggttccgaggcaattcacctttcgagaaagcgaagtcctcgaccgtcgccatcgaggtcaacaacatcgtggcgctctcgaaccagacctatcagatcgactggacggaatacgagcgagaccgcaagggcaaggaaaccggcacacgccgcttccgcggcatcgcaacggtggcgctcaccgcgccacaggatgaggcgacgatccgcctcaatccgatcggcctctatgtccgggatttcgactggacggcacagctttaagggcagggatttctcaatgcaaaagacaggattgatcgcagccgccggctgcatggccggactcgcctttgtggtgggcgcgcaggcgcaaagcatgacgagcaacgaggtcaagggtacgaatatctcccgcaaatggcgcggcacaccgggcctggtcacaacgggaccggacggcaaagtgatttttctgttcggcgagacccagccgtccgtcgtctgctcgccgctgcaggtctgcgacatcgagcttcagggcggtgagatcgttcgcgacgtgctcgtcggcgatacggtgcggtggaaagtggagccggccacctcgggggcgacaggcgggcaggccatccatctgattgtcaaaccgtcggagccaggtcttctcacctcgatggtcgtcaccacctcacggcgaacctatcatatccagctcaagtcccatcccagccagtacatggcgcgcgttggtttcgagtaccccgaggacacctccaccaagctcgccgacatcaatgcccgtctcgaaaccggcggcattccgggcacggcgccggataagctgaacttctcctattcgatcagcggcggggcttcgtggaaaccgaagcgggtctattcggacggggtcaagacctacatccaattcccgaagtcgatctcaggtcaggatgcgccggtgctcttcgtcgtctccggcggtcagaaccgcatcgtcaactaccggatgaagaacaacatgatgaccgtcgactatgcgatcgacaaggcgatcctcgtatcaggggtcgggtggcggcagcagaagatcaccatccggcggggaggctgaaccatgcgcaagctcctcgcactcttcatcgcggccaaactactctccggttgccaaacggccgacgacgcgatgaccaccaatgcaaccccggttgccgtcaccggaccggccgcaagcgcgatcgccggtgacatggcaagtcgtctcgccgaacaaatcggtccggccagcgctgcgacgaccatcaaaatggaaaaggaccagtcggaattcgcgaccgccctcgaggcggccctgaagggctggggttatacggtcgtcacggacggcaaggtcgccaaagacatcaagccggtcgagcttgcttttgccgtcgagggcttcgacgggcaggtttttgcgcgcgtttcgacgccttccatcgctcttggccgcgcctatacgccgacggcggccggcgccacgccgaccagtccactttcgatcatgcagcgcaactgacggagagcaatatggtccagtcgctccaacttggcgcgccagcccagtccgacgatcagaatggcatgcgccggctcaaccgcctgccgatcatcatcgccatcatcgtcgtcgcgctcttcgttggcgtcgtcgtgatcggcctgtcgctgcgggggctgtccttccatcgaggcgacatcgagggggcttccaacaccccggcgaccagcttcggcgaccagctcaaacggggtgtcaccgacggcatcatcggcgagccggagaagcaggaagtgtttcaaccgacccctgtcgtcgagcagaaggtcgagaaacaggagaccgccgttgaacgccggccgaatgaccgacaggagagacgctcgctcgaatccgaggaggagtggaaggctcgcctgaagcgggagcaggacgagcagtatatccgggaagcgcagcgccagcggatggctcgcctccaggctcgcgctacggcgctcgattcgccgctgaaggtagacatcggagacttcgagaaggcaacctccaccaatgacagcggccgccagccgacaaatgcagccgtcaacagtgcgtcggacctttatgccgccgccatgaaatccggcctgatgggccaaaacgtcgatcagaacggacagccgtcgaaggaggattttttcaatcaggacatcaaggatctcggctacctgccaaaccaggtcgtgccgcagatgtcaccctacgaactgaagcgcggctcggtcattcccgccaccttgatcaccggcctcaattccgacctgccagggcggattaccgcgcaggtcagccagaatgtctacgacagcgcgagcggctatcgcctccttatcccgcagggcgcaaagctgttcggtcgctatgattccaaggtctcattcggccaggagcgtgttctcgtcgtctggactgaccttatttttcccaatggatccaccctgcagatcggcggcatggccggcacggacgccgaggggtatggcggcttccaggacaaggttgaccgccatctctggaggacgttcggttccgcagctctggtggcaatcatcgggacggggatcgacatgtcgatgccggagagttcaacattggccacccaggacacggcatcggatgcagcacggcggaattttgccgaaagcttcggtcgcgtcacagaacagacaatctcgaagaacctcaacgttcagccgacgattcgcatccgtcctggctataagttcaacgttctcgcggaccaggatatcatctttccatccatttatagcgggcgctaacccatctcgaacgctgctccgcccgtcgtttcgtcgggtggagcgatccatccgcgctcagaaatcagcgctcgccaaaatcttctctcaaattgtcatattttagatgaagaggccttgaatactcggtagaggtgagtagaaaaccagttgcaacggccgtggatatgcttcggcagaaggcaactgcgttttcatcggaaacgaatggggacacggaattcgcagccacggtccgatgttccgtatggctccggctggccgaacggtggcaccaggtaactcgcggcgcgtggtaggcgcgacgggtgggaggctcgcagctgcgcaagaggagacaagtccgtggacggagaccttcgctctttaatcgatatgacggaagctgcgcacgatgaacgcatgatcaagggcgccctgaaaagcttcgtaaactcccatggcttcgaacgttttgcgtatcttcagaccgagggcctggaaatccgcacattcaactcctatccggagggatggcaggatatctatcttggcggccaatattcgcgcatcgaccccgtcatcacggaagccaagcgtcgcatggagatgttctactggacggccgatgattggccggctcgtggcacctcggagctgagacggtttcgcgaccaggcgatcgagcacggcattcgcagtgggctgacgattccggtcgaagggagtttcgggtcgacgatgatgctgacctttgcctcgtcggagaagaaagtcgagaaagccaaactgctggacgcccagaaagccgtccggacggtccttgcaatccattaccgcctgaagattatcgcttcgacgacgataatcgctccgaagcggctactctcgccaagggaagcgatgtgcctcatgtgggcagcaaagggcaaaagtgccccggaaaccgcaatgttgacggggatcaacgcgaggacggtgcagcactacctcgataaagcgcgcgagaaacttgacgcggcgaccgttccacatctagtcgcgatcgctaaagatcacggcttggtttga

SEQ ID NO: 142 - protein, 207 aa, Agrobacterium strain K599 (NCPPB 2659)
MQVLAISTPKNIQEAELIHRHHELRARVFADRLGWDVEVIDGVELDAFDTLIPTYILAISDSRQVAGCARLLPAPGPTMVADVFHSLLPNGRLNAHSAMIESSRFCVDTALGEGRGDGSVHEATLTMFAGIIEWCMSNGFTEIVTVTDLRFERILARVGWPLQRLGEPRKFGVTMAVAGILLADASTFQKLRPANYRSEFTSLSKAA

SEQ ID NO: 143 - protein, 129 aa, Agrobacterium strain K599 (NCPPB 2659)
MLNPDGKLFIERLGHGVAPAGEMSPAAAEMVIGTVAHALQSEVDTEQPIISGELPIGGHRFEGLLPPVVARPAFTIRRRASRLIPLEDYVRTGVMTEYQAATIRSAISARLNIIISGERARARRRLRML

SEQ ID NO: 144 - protein, 127 aa, Agrobacterium strain K599 (NCPPB 2659)
MSHRKSFIAVALLAAPIVLASVAPTLASSGGSLPWEGPLQQIQESITGPVAGAIALAAVAIAGGMLIFGGELNDFARRLVYVVLVAGILLGATNIVGLFGATGASIGLTSEQLTTIGSAGGGEGTHG

SEQ ID NO: 145 - protein, 818 aa, Agrobacterium strain K599 (NCPPB 2659)
MVALKRFRATGPSFADLVPYAGLVDNGVLLLKDGSLMAGWYFAGPDSESATDLERNDLSRQINAVLSRLGSGWMIQVDAIRIPTVDYPTEDRCHFPDPVTRAIDGERRAHFAREQGHFESKHALILTYRPLESKKTALSKYIYSDEESRKKSYADTVLFVFKNAVRELEQYFANTLSIRRMETRETVGRGGERIARYDELLQFARFCITGENHPIRLPDVPMYLDWIATAELEHGLTPKVENRFLGVVAIDGLPAESWPGILNSLDLMPLTYRWSSRFIFLDAEEARQKLERTRRKWQQKVRPFFDQIFQTQSRSVDQDAMTMVAETEDAIAQASSQLVAYGYYTPVVVLFDNDREALQEKAEAIRRLIQAEGFGARIETLNATDAYLGSLPGNWYCNIREPLINTSNLADLIPLNSVWAGNPIAPCPFYPPNSPPLMQVATGSTAFRLNLHVDDVGHTLIFGPTGSGKSTLLALIAAQFRRYENAQIFAFDKGSSLLPLTLAAGGDHYEIGGDNAEEGRALAFCPLSDLESDANRAWATEWIEMLVGLQGVTITPDHRNAISRQVGLMASASGRSLSDFVSGVQLREIKDALHHYTVDGPMGQLLDAEEDGLTLGAFQTFEIEQLMNMGERNLVPVLTYLFRRIEKRLDGSPSLIVLDEAWLMLGHPVFRSKIREWLKVLRKANCAVVLATQSISDAERSGIIDVLKESCPTKICLPNGAAREPGTREFYERIGFNERQIEIVSNAVPKREYYVATPEGRRLFDMSLGPVALSFVGASGKDDLKRIRALKSGHGREWPIRWLETRGVHDAASLLKFE

SEQ ID NO: 146 - protein, 39 aa, Agrobacterium strain K599 (NCPPB 2659)
VSRSVLIALVLAVAAASAAATVLIVKSSDGGRPALTEEQ

SEQ ID NO: 147 - protein, 393 aa, Agrobacterium strain K599 (NCPPB 2659)
MVKPAVTRSLLITGLFFLAYAAPAFAQEGQVLTELENQVSSAAKGWETTIMDAAKSLFWILATIEIGIAAVWLAIQSASLDSWFAELVRRIMFVGFFAFVLTQGPTFARAVVDSLFQIGAGGGSASPAEVFDAGIRVASQMSQQAQFGVFEDNALAIAAVLAMGVVVICFSLVAAIFVSVMVEMYVGLLAGMIMLGLGGSSFTKDFAVRYLVYAFGVGMKLMALVMIAKIGSQVLLGLANAPTASSDQFVTTLAIAGISVVVFIIAMYVPNIIQGVVQGASVTGGMETIRHGGQAASFAAGAGFLAAGAAGAGFAAAQAARAGGSSVAGAALRGIGASFSSGAQAAGSAAKEKAIGSPGAYAGSILGLANAKLDEQRSGHSGPTPPPERNDKP

SEQ ID NO: 148 - protein, 220 aa, Agrobacterium strain K599 (NCPPB 2659)
MAANRAPDNPYLAARQEWNERYGTYVKAASAWRIVGILGLTMAVIGFSYAMYLSTQVKLVPYIVEVDKLGTAVTAGFPEQIEYADVRVVRATLGNFVTSFRSITPDAVVQKQYIDRTYALLRTSDPSTEKVNAWFRGNSPFEKAKSSTVAIEVNNIVALSNQTYQIDWTEYERDRKGKETGTRRFRGIATVALTAPQDEATIRLNPIGLYVRDFDWTAQL

SEQ ID NO: 149 - protein, 270 aa, Agrobacterium strain K599 (NCPPB 2659)
MQKTGLIAAAGCMAGLAFVVGAQAQSMTSNEVKGTNISRKWRGTPGLVTTGPDGKVIFLFGETQPSVVCSPLQVCDIELQGGEIVRDVLVGDTVRWKVEPATSGATGGQAIHLIVKPSEPGLLTSMVVTTSRRTYHIQLKSHPSQYMARVGFEYPEDTSTKLADINARLETGGIPGTAPDKLNFSYSISGGASWKPKRVYSDGVKTYIQFPKSISGQDAPVLFVVSGGQNRIVNYRMKNNMMTVDYAIDKAILVSGVGWRQQKITIRRGG

SEQ ID NO: 150 - protein, 146 aa, Agrobacterium strain K599 (NCPPB 2659)
MRKLLALFIAAKLLSGCQTADDAMTTNATPVAVTGPAASAIAGDMASRLAEQIGPASAATTIKMEKDQSEFATALEAALKGWGYTVVTDGKVAKDIKPVELAFAVEGFDGQVFARVSTPSIALGRAYTPTAAGATPTSPLSIMQRN

SEQ ID NO: 151 - protein, 430 aa, Agrobacterium strain K599 (NCPPB 2659)
MVQSLQLGAPAQSDDQNGMRRLNRLPIIIAIIVVALFVGVVVIGLSLRGLSFHRGDIEGASNTPATSFGDQLKRGVTDGIIGEPEKQEVFQPTPVVEQKVEKQETAVERRPNDRQERRSLESEEEWKARLKREQDEQYIREAQRQRMARLQARATALDSPLKVDIGDFEKATSTNDSGRQPTNAAVNSASDLYAAAMKSGLMGQNVDQNGQPSKEDFFNQDIKDLGYLPNQVVPQMSPYELKRGSVIPATLITGLNSDLPGRITAQVSQNVYDSASGYRLLIPQGAKLFGRYDSKVSFGQERVLVVWTDLIFPNGSTLQIGGMAGTDAEGYGGFQDKVDRHLWRTFGSAALVAIIGTGIDMSMPESSTLATQDTASDAARRNFAESFGRVTEQTISKNLNVQPTIRIRPGYKFNVLADQDIIFPSIYSGR

SEQ ID NO: 152 - protein, 224 aa, Agrobacterium strain K599 (NCPPB 2659)
MTEAAHDERMIKGALKSFVNSHGFERFAYLQTEGLEIRTFNSYPEGWQDIYLGGQYSRIDPVITEAKRRMEMFYWTADDWPARGTSELRRFRDQAIEHGIRSGLTIPVEGSFGSTMMLTFASSEKKVEKAKLLDAQKAVRTVLAIHYRLKIIASTTIIAPKRLLSPREAMCLMWAAKGKSAPETAMLTGINARTVQHYLDKAREKLDAATVPHLVAIAKDHGLV

SEQ ID NO: 153 - DNA, 2240 bp, Agrobacterium strain K599 (NCPPB 2659)
  CDS (1)..(1152): rcorf102, similar to hypothetical integrase gene orf2 (similar to Pseudomonas integrase-like gene) in pTiA6NC homolog.
  CDS (1254)..(1928): rcorf101, similar to N-term. fragment of pAT 22 Agrobacterium tumefaciens str. C58 (strain: C58, isolate: Cereon), a COG0582 [L] Integrase protein.
  CDS (1929)..(2240): rcorf100, similar to C-term of pAT 22 Agrobacterium tumefaciens str. C58 (strain: C58, isolate: Cereon), a COG0582 [L] Integrase protein.
atggcccatatcatcgagcaaaacgacgaaaatcacgccacagagacctcctctccgtctgagagcacgaccgctcgcgacgctattgccgcgccgcagatggcggtcggcatctcgacggccagcgctggcctcccctcccctcttccggaggcgcggaccttgccggcgcacctcgagcagctcgccgaacgcgcccgtacctatgtcgaggcggcgagcgccgccaacacccgcaaggcctacgcctccgactggaagcacttttccgcttggtgccgccgccagggtctcgcgcccctaccgcccgatccgcacaccgtcggcctgtacattacggcgctcgcgtccggcactgctgcggccgatcgcaagcccagctccgtcacgacgatcgagcgccgcctttcggcgctgacctggagctacgcccagcgcggcacgccgctcgaccgcaaggaccgtcatatcgccaccgtaatggctggcatttgcaacacgcacgccgccccgccgcggcagaaggaagccctcctgcccgaagacctgatcggcatgctggaaacgctcgacaggggaaccctgcgcggcctgcgcgatcgcgccatgctgctgatcggctttgccggcggtctgcgccgttccgagatcgttgggctcgatatcggccgcgaccagagcgaggacgcgcgcggctggatcgagatcctcgagaagggcctgctcgtcaccctgcgcggcaagaccggatggcgggaggtggaagtcggccgcggctcgtccgatgcgacctgtccggttctcgctatcgaaacctggatcaagttcgcccggattgccaagggtccgctgttccgccgcgtccgcggccagggcaaggatgtcggaccggaccggctgaacgatcgcgaggtcgcccgtctcgtcaaaaaggcggcactggccgccggcgtcaggggcgacctcaacgaggccgaacgcgcggcaaaattctccggtcactcgctgcgcgccggtctggcctcctccgcggaggtcgacgagcgctatgtccagaagcagctcggccatgccagtgcggaaatgacgcggaaataccagcgccggcgtgaccgctttcgcgtcaatctcaccaaagccacagggctttgaggcccctcccctgctcactatgaactcgttggggcaaattgcgtgtcggatttttagctttccgcttcaattgaaattgttagctaaaagccacacagcgcatgggcgacaatacgctccgggcgctgacctccgatctcgcctatttcgaagcctggggtctggcggcctccggaaaatctctaccctggccggcgcccgaagcgctgctcctgaaattcgtcacccatcacctgtgggatccggagaaacgtactgccgattcagatcacggcatcccggcagacgtggccgaaaacctccggcaccagggattcctcaagtccgccggcccacatgcgccggcgaccgtgctccgtcggctggcgaactggtcgacactgaccagatggcgcgggcttaccgacgccttcggctcccctgccctcgaatccgccgttcgtctggatgtgcgcgccgtcctgcggcaacgccgccgcaaaagcgcaaaggcggtcaccggcgacgtgctggccaagctgttggtgacgtgcgcgaccgaaagcccgcgtgatctccgcgaccgggcgatcctgatggtcgcctttgcctccggcggccgccggcgcagcgagatcgcaggccttcgcctggaacaactgaccgtggaagctccgatcgagaccgaaggcggcactcccctcccctctctcgccattcatcttggccgtaccaaaacgacgtcaggcgaggaggacgagtcgtctatctcaccggccggcctgtcgaggcgttgaatgcctggctggcggcgggggaagatcgacaagggcagcgtgtttcgggggggggggcgggcgctgggggacaatttcgcggcgggcgctcgatccgcagtcggtcaacgccgttatcaagcagagggtggagatggccgggttggagagcggggagttttcggcccatgggttgcggtcaggtatctggccgaggcggcgaaccgaggcattcccctacccgaggcgatggagcagtcacgtcatcgctcgattcaacaggcatccagcaatgccaccagacggtgtggacgcgcggcgcgcttgttatga

SEQ ID NO: 154 - protein, 383 aa, Agrobacterium strain K599 (NCPPB 2659)
MAHIIEQNDENHATETSSPSESTTARDAIAAPQMAVGISTASAGLPSPLPEARTLPAHLEQLAERARTYVEAASAANTRKAYASDWKHFSAWCRRQGLAPLPPDPHTVGLYITALASGTAAADRKPSSVTTIERRLSALTWSYAQRGTPLDRKDRHIATVMAGICNTHAAPPRQKEALLPEDLIGMLETLDRGTLRGLRDRAMLLIGFAGGLRRSEIVGLDIGRDQSEDARGWIEILEKGLLVTLRGKTGWREVEVGRGSSDATCPVLAIETWIKFARIAKGPLFRRVRGQGKDVGPDRLNDREVARLVKKAALAAGVRGDLNEAERAAKFSGHSLRAGLASSAEVDERYVQKQLGHASAEMTRKYQRRRDRFRVNLTKATGL

SEQ ID NO: 155 - protein, 224 aa, Agrobacterium strain K599 (NCPPB 2659)
MGDNTLRALTSDLAYFEAWGLAASGKSLPWPAPEALLLKFVTHHLWDPEKRTADSDHGIPADVAENLRHQGFLKSAGPHAPATVLRRLANWSTLTRWRGLTDAFGSPALESAVRLDVRAVLRQRRRKSAKAVTGDVLAKLLVTCATESPRDLRDRAILMVAFASGGRRRSEIAGLRLEQLTVEAPIETEGGTPLPSLAIHLGRTKTTSGEEDESSISPAGLSRR

SEQ ID NO: 156 - protein, 103 aa, Agrobacterium strain K599 (NCPPB 2659)
MPGWRRGKIDKGSVFRGGGRALGDNFAAGARSAVGQRRYQAEGGDGRVGERGVFGPWVAVRYLAEAANRGIPLPEAMEQSRHRSIQQASSNATRRCGRAARLL

SEQ ID NO: 157 - DNA, 3800 bp, Agrobacterium strain K599 (NCPPB 2659)
  CDS (1)..(1896): rcorf116, probable potassium uptake protein, similar to Atu0711 iAgrobacterium tumefaciens str. C58 and riorf148 in pRi1724 and to kup gene, a pfam02705: K_trans; K+ potassium transporter protein.
  CDS (2991)..(3800): rcorf115, similar to riorf147 in pRi1724 and y4mC gene in pNGR234a homolog, a vir induced gene.
atgtccgcagaaagccatccgaccgaatcccagatgacgccgaaaaagctgttctatctgacgctgggttccatcggcgtcgtttacggcgatatcgggaccagcccgctctacgcctttcgcgaggcgttgaagccggtggcccatgacgggctcacccgtttcgaggtcatcagcctgatctcgctgatgatctgggcgctgacgatcatcgtcaccatcaaatatgtgctcttcctgctgcgcgccgacaacgaaggcgagggcggcacgctgtcgctgcttgctcttttgatgaagaccgccaacggccataccgccatcctgatgctgctcggcctcttgggggctgcgcttttcctcggcgacgcgatgatcacgccggcgctgtcggtgctgtcggcggtcgaaggcctgaagctcgtcacgcccaggctctcggaatatatcgtgccgatctcggtggtgatcctggcgctgctcttcgtcgtgcaatcgcgcggcaccggcgccgtcgccaaattcttcggcccgatcaccgccgtctggttcctcgtcatggccgccgccggcatttcgcatatctcggacgatttcggcattcttgccgccttcaatccttactatgccgtcagcttcctgctgcatgagggcttctacggcgtcgtcgtgctcggcgccgtcttcctgacggtgacgggtgcggaggcgctttatgccgatctcggccatttcggccgtcgcccgatccagtgggcctggttcctgctggtcttcccgtcgctgacgctgaactatctcgggcagggcgcactcgtgctcggcaagccggagacgatgtcggatcccttctacctgatgtatccgcaatgggcgctgctgccggttgtcatcctggcgaccgcggcgacgatcatcgccagccaggctgttataacaggcgctttctcgatggtgcgccagggcatcaaccttggcttcctgccgcgcagggaaatcctcttcacctcggaaaccaataccgggcagattttcgtgccctcggtcaatgccgtgctgttcatcggcgtcatcttcctggtcctgagtttcaaaacctcggacgcgctggcgaccgcctatggcatctccgtcaccggcgccatggtcgtcacctcgatcatggccttcgaattcgttcgcgcccgttggaactggtcgctgccggttgcggtgatcgcgctggcgccgctggtcatactcgaattgatcttcctcggcgccaatcttttgaagatccacgacggcggctatatcccgatcctgatcgccacggcctttaccgtcatcatgtggacctggcgccgcggcactgcgatcctgatggaaaagacccgccacaccgatattccgctcgcctccttcgtcagctcgatcgagcgcaagagcgaacattcgccggcccaggttcccggcacggcgatcttcctgaccagcgatccggaatccgcacccgccgccctgctgcacaatctcaagcacaatcacgtgctgcacgaccgcaacgtcatcctgacgatccgcacggtcaacaagccgcgtgtgccgagtcaggaccgttacaaggtcgagcagatttccgagcgtttctcgcgcgtcgaactgctgttcggcttcatggaatcgcagaacgtctcacaggcgctcgcgacgctgcgcaaggccggactgaagttcgacatcatgtcgacctcattctatctcggccggcgcaagctggtgccggacgccaattcaggcatgccctactggcaggaccggttctacatcctccttgcgaatgcggcctcactcccatcagactattttcaccttcctgccaaccgggttgttgaactgggatcgcagattatcgtttagacgcggcccctgacggcgaccggcgaggaccactctcgacagtgtttggcaaacaagggattgtcccgactttgcgagcaggttcggaccaatatctgcctctaatgcagagcgagccgcattcatccagccccgttggattacagctgaaactgaccttctcccacggcaaatcattttagcacattcagattgcataggggtgaaagctgtacaaggagactgaaccatgagcctgaacgaaaaaccaggtactgcaaacagccgctcggatctggagccggctggtgtcgacggcacgcaatcgacaagattgccaaccgcttcagagatcgagggaccaaccgttgcgctacaaagatcattttttcaacagttgctcttggactttgcctacggatgtgaatttttttatccactacagcaatatgaagctttcacttcgaaagcaaaagacgatgatgagaactgatggcggccactcgccgaaggagttcaaggcggcgacgcttgaatcggttctcgtttacgaatgcgccgcgcctgacgcggattcagatcaaatgttccaaagctacccgcaccccattgccaatgtcgagagatgacgacttccaacgacgccttggcgcctcaaagcggtatggcttgtcgtgatacaataaccgactgcagaaattgccatgtcaatgcggtgggagtgggcgactgaccgggggaaagccgtttggtacatacatctacgtcttaatccgaaacaaagtgcactcgaatttcctgaagtaatgagaagccaacgtagttttttcggtatgacatccaacggcaacgcgtccgaaggcaatgctttacatttgtaacacgattgacatttaaccaacctcgaaggaacgctagaagttccagtacaccaaacgagctgaactcaacggtggacaatcagaacgattgggcggccggcggaagatgcatgagcagacacgaaagccggaacaaactgccccgctggccactccgcgaacagcgatgcttccagtcctccccaagatcaacattcaactcgcccacgcacatccagggagtaattcagtatgtcgaatttttgcttaaagtctgtgcaggtaacagcaatcgcatcgactatagcgctcgtgctggccgcgaataccttggcacaagaatcttccaccgcctctccatggccggacacaccaaccgctcggatcgaggcgctcgcagttctccagaccttgaatgcaaatctcctgggaaatcctagcgccaccttgacgctcgatcgctggtgtgccgcgcacaaactcgccccggaagactccaagatcgttgcccagcgcgtgcgcgtacaagacacgcccgccgatagcagtatccgagaacttcttgccgtgggatcagaggagcctatcgcttatcgccgcgttcgcctggtttgcggaaatcgcgtactatcagaagccgacaactggtatgttccggcgagactgacaatggaaatgaataacgcgttgagcaccagtgatatagcgttcggcagggccgttcagtctcttaacttcacccgcaccaacctatcttccaatctgctttggtctcctctaccagaaggctgggacatgggaaatgaattaactgcgaaccggagaggaccactggtcctgccaccgtttcttctcgaacatcgtgccgtgttgaagctgcaggacggcacaccattcagtgctgtggtagaaaagtacacaaacaaagtgttggattttccggctccgatagcaatccaaggctggctattgggacgcacgacccgagcgtcgggcagcacgcccacgcgctcctgttctacatctccggtcgagccttgtcctatgtcaatctcacgatga

SEQ ID NO: 158 - protein, 632 aa, Agrobacterium strain K599 (NCPPB 2659)
MSAESHPTESQMTPKKLFYLTLGSIGVVYGDIGTSPLYAFREALKPVAHDGLTRFEVISLISLMIWALTIIVTIKYVLFLLRADNEGEGGTLSLLALLMKTANGHTAILMLLGLLGAALFLGDAMITPALSVLSAVEGLKLVTPRLSEYIVPISVVILALLFVVQSRGTGAVAKFFGPITAVWFLVMAAAGISHISDDFGILAAFNPYYAVSFLLHEGFYGVVVLGAVFLTVTGAEALYADLGHFGRRPIQWAWFLLVFPSLTLNYLGQGALVLGKPETMSDPFYLMYPQWALLPVVILATAATIIASQAVITGAFSMVRQGINLGFLPRREILFTSETNTGQIFVPSVNAVLFIGVIFLVLSFKTSDALATAYGISVTGAMVVTSIMAFEFVRARWNWSLPVAVIALAPLVILELIFLGANLLKIHDGGYIPILIATAFTVIMWTWRRGTAILMEKTRHTDIPLASFVSSIERKSEHSPAQVPGTAIFLTSDPESAPAALLHNLKHNHVLHDRNVILTIRTVNKPRVPSQDRYKVEQISERFSRVELLFGFMESQNVSQALATLRKAGLKFDIMSTSFYLGRRKLVPDANSGMPYWQDRFYILLANAASLPSDYFHLPANRVVELGSQIIV

SEQ ID NO: 159 - protein, 269 aa, Agrobacterium strain K599 (NCPPB 2659)
MSNFCLKSVQVTAIASTIALVLAANTLAQESSTASPWPDTPTARIEALAVLQTLNANLLGNPSATLTLDRWCAAHKLAPEDSKIVAQRVRVQDTPADSSIRELLAVGSEEPIAYRRVRLVCGNRVLSEADNWYVPARLTMEMNNALSTSDIAFGRAVQSLNFTRTNLSSNLLWSPLPEGWDMGNELTANRRGPLVLPPFLLEHRAVLKLQDGTPFSAVVEKYTNKVLDFPAPIAIQGWLLGRTTRASGSTPTRSCSTSPVEPCPMSISR

SEQ ID NO: 160 - DNA, 1833 bp, Agrobacterium strain K599 (NCPPB 2659)
  CDS (1)..(696): rcorf136, probable virC1, similar to riorf166 in pRi1724, virulence virA/G regulated protein, AGR_pTi_18p; VirC1; binds to overdrive sequence adjacent to right border of T-DNA; increases the level of T-DNA processing
  CDS (699)..(1304): rcorf135, probable virC2, similar to riorf165 in pRi1724, T-DNA processing virulence virA/G regulated protein
  CDS (1468)..(1833): rcorf134, hypothetical protein, similar to aa4-122/142 of ISBm1 transposase orfA [Brucella suis 1330] (NP 697551)
atgaaacttctgacattttgctcatttaaaggaggcgccggcaaaaccacggcgctcatgggcctttgcgctgcgtttgcaagagacggcaaaagagtggctctcttcgatgcggacgagaaccggccgttaacgcgatggaaagaaaacgcgatgcgtagcaacacctgggatacatcctgcgaggtgtacgctgcagaagaaatgtcgcttcttgaagcggcttatgaggacgccgagcttcaggaatttgattatgcgctggccgatacgcatggtggttcgagcgagctcaataacacaatcatcgctagctcaaacctgcttctgatcccgacaatgttaacgccgctggatatcgatgaggcactttcgacatatcgttatgttgtcgagctgctgctgagcgagaacttagtgattccgaccgccgtgttacgccagcgagttccggttggccgattaaccacgtcacaacgcgcgatgtcagacatgctggtgaatctgcctgtcgtacaatctccaatgcatgaacgagacgcgttcgctgcaatgaaagagcgtggcatgttgcatctcacattgctgaacacgacaaatgatccgacgatgcgcctccttgagcggaacctcagaattgcgatggaggaactcgtaacaatttcagaattgattggcgataccttggggaattgaagatggggatccgcaaacctgctttgtctgtcggtgaagcaagacggcttgctgccgcgcgaccgatcgttcacccaatcccagctctttcctcgcaaaacttggcgccttcgcaattacctgaaagagccggaaaggaaaaacgaccagcgcctcctatcgccgccaaacgtcgtgacaacttcgatcggcaatcaatgctaacggcggacgccttgagttcgactgcgccgccggaaaaagtccaggtctttctttcggcacgcccccccgctcctgaggtatcgaagatatatgacaacttgattctgcagtacagcgctaccaaggcgctgcagatgatcttgcgccgtgcgctcgccgattttgagaacatgttggcggacggatcatttagcacggggcctcaaagctacccgatctcaaaagtagtcgaaaaacctatcgttgtcctgacttctcgcatgttcccggtatcgctgttagaagtcgcacgcaatcactttgatccattgagattggagaccgccagggcttttggccacaaactggctacggccgcacttgcatctttctttgccgaagagaagataagaaaagaacgctaatatgatgaggccggtcacttgacggcggtattgtattcgacagcaggcaatgaggcagcccctacccagctacaacacagccagctcactctaggctgtgtccccataacggggttcatgttgatgacgttgtgtgattcaatttcctggaaaggagattgttatgcgccgtcacgaactgaccgacgaggaatgggcggttatcgcccctttgctgccgaccaacagccgtggagttgagcgcgtggatgaccgccgggtgatcaatggtatcctatggcgtttccggacaggttcatcctggcgtgatgtaccggagcgctatggtccgcgcacgacgctctacaatcgcttctctcgctggcgcaaggcaggcgtctgggatcgccttcccggcgctgtttcaaggcattatgccggagagatcgtcatgatcgattcttcctgcgtccgcgttcaccagcatggtgcaaacgaaaaaaagggggatctgccgatccttgcatgggacgttcgcgtggcggcctga

SEQ ID NO: 161 - protein, 231 aa, Agrobacterium strain K599 (NCPPB 2659)
MKLLTFCSFKGGAGKTTALMGLCAAFARDGKRVALFDADENRPLTRWKENAMRSNTWDTSCEVYAAEEMSLLEAAYEDAELQEFDYALADTHGGSSELNNTIIASSNLLLIPTMLTPLDIDEALSTYRYVVELLLSENLVIPTAVLRQRVPVGRLTTSQRAMSDMLVNLPVVQSPMHERDAFAAMKERGMLHLTLLNTTNDPTMRLLERNLRIAMEELVTISELIGDTLGN

SEQ ID NO: 162 - protein, 201 aa, Agrobacterium strain K599 (NCPPB 2659)
MGIRKPALSVGEARRLAAARPIVHPIPALSSQNLAPSQLPERAGKEKRPAPPIAAKRRDNFDRQSMLTADALSSTAPPEKVQVFLSARPPAPEVSKIYDNLILQYSATKALQMILRRALADFENMLADGSFSTGPQSYPISKVVEKPIVVLTSRMFPVSLLEVARNHFDPLRLETARAFGHKLATAALASFFAEEKIRKER

SEQ ID NO: 163 - protein, 121 aa, Agrobacterium strain K599 (NCPPB 2659)
MRRHELTDEEWAVIAPLLPTNSRGVERVDDRRVINGILWRFRTGSSWRDVPERYGPRTTLYNRFSRWRKAGVWDRLPGAVSRHYAGEIVMIDSSCVRVHQHGANEKKGDLPILAWDVRVAA

SEQ ID NO: 164 - protein, 372 aa, Agrobacterium strain K599 (NCPPB 2659)
MAAALGTGNSTIMTQSFDIELSHCRKTYGDINVLDDVSLQVKNGEFITVLGPSGCGKTTTLRVIGGFIIPDSGRVSIRGREVTNLPPYKRNIGVVFQNYALWPHMTVAEILSFGLRIRKLPREEIARRVDRALSMVQLTGLKDRYPRELSGGQQQRVAMARALAIDPEVIILDEPLSNLDRRLREELRIELKRLQRSLGVTMLFVTHDQEEALSMSDQVVVMQSGRIQQIADPRTVYERPANRFVAGFLGSANFLPGELVQNSKESRAEIKLSNGAVVTAHAPSARAVGEKVTVIVRPEWLVLERQGSNPPANQLEGTVGDVIYEGSAIRYGIKLTHEPEAPVFLQERSNADVLKPGDKVRINVTNAVVAAE

SEQ ID NO: 165 - protein, 281 aa, Agrobacterium strain K599 (NCPPB 2659)
MSATTTVSTGKGVSARKVWLPLPTGLGIAAFCAFVTVVAPLFVVAGAALNAEAMFFPPKQLTLHWMIAALTDRSFVNGALISFAVAAVAATVSTIFALPVALQLRKAPPTVAKVLTLSFMGPLLVPSVIFALSLYSVMIYAFGVTNLFALVIGHVMITMPYPVRTITAVTENLDPALEDAASSVGANPWRTFVSVTLPLIKPGVIAGFLFAFITSWNDFSISVFLTPRELQPLPIKIYEYLLYQYRPLIAAVATWSVIGSAIVVLIIDRLVGLNVFTGRRG

SEQ ID NO: 166 - protein, 248 aa, Agrobacterium strain K599 (NCPPB 2659)
MSWGRDPFERFRHSTRARIGLGRAGDALPTSAILDFQLAHAKARDAVHGQVDFVALAKQLAPVSTIRIRSCATDRTIYLSRPDLGRQPLAADLPMPGDSHDIAFVIADGLSASAVERHAVPLFKACMKRLGGFSVAPVILGEQARVAFGDEAAAAFGAEVAIVLIGERPGLSVPDSLGAYITFRPQAGRRDSERNCISNIHADGLGYEIAADKIAWIVREALRLQLSGVALKEGAESSAKISSNPGQE

SEQ ID NO: 167 - protein, 521 aa, Agrobacterium strain K599 (NCPPB 2659)
MEFNRRSLLKSSALAGIALGMPILNTKFLVNPANAAENKVLKFLSAETLTGNWDPSSHTTLAQINLESFVFGYLTRAPMTPEKPDELVMELATEMKLIDEHTLEFKLREGVTFHDGKPFRAEDVKATFEYASRPDRPAAWYPGPCEVEVVSDYVARVKTDKAGYPASLFWFLSSFLPIMSAKDVADPKTLSARPNGTGGFKFVKQDGNTTVLEAFDNFYLGKPTIPGLHFSFVGDATTRTLALLNGEADLIERLEAEQVETIEKTGGFQLHKAISVENKYLWFRCSKPPFNDWRLRRAVCHAIDRSVIDDILGVSGHASNCYVSPVKFGYVDIPNYPKFDPDQCQKLLAEAGFPKGEGLPELEYITSVGFYPKTKEYAEAITAMLQEQGFPVKLNVMEVAAWGDALYDRPGGGPGHMIDCGWSTGSPEPDLVLRTHFHSTTHRICGIQDPEIDAALDKERNASKPEERKKVIQTELMPLLAEKTPSFSLFTSVFIHGMRDGLSGLYIYPNGMMDANKATLA

SEQ ID NO: 168 - protein, 309 aa, Agrobacterium strain K599 (NCPPB 2659)
MQDDAAVQAALDAVGLSGATLSAPIGGVVSPIHRGVENLCFFASKADQPRVFVKRLHDDMSRFVALNHVAEASRKAGELGIAPRLIHAAPEGGVLVFEALGEEWAWGHADVLRRPRVLENLLTAKRSFHQAERLGETRSVFELVAAYRQLAEGADVILPAPVFTVSAAVERIAGAIGAAGVDTVPCHADGISSNVMVGPDDGVRLVDFEWARQADPAYDIGTVLAELLPFDGEALLAIEIATGKPDASVLARARLYGAADDLMWALWGFINAARSPRKHVEFFKYAEWRLLRARTVIEGPRFETWLKQV

SEQ ID NO: 169 - protein, 500 aa, Agrobacterium strain K599 (NCPPB 2659)
MTGYVLAIDQGTTSSRAIVYGPDAQPIAIDQKEISQSFPKSGWVEHDATEIWDSVVETSRTALARAGIEARDVAAIGITNQRETCLIWERSTGKPIHPAIVWQDRRTFGACEVLRADGFGPLIQEKTGLLLDPYFSATKIAWILDNVDGARRAAENGQLLCGTIDTYLTWMLTGGAVHATDATNASRTSLFDIRQNRWDDELLGAFRVPRALLPEVKDCADDFGQTVAAHFGAQIPIRALAGDQQAALLGQACLKPGMLKSTYGTGCFVVLNTGDQIVRSSNRLLSTIGYRLNGKTTYALEGSIFMAGAAVQWLRDSLKLIKAADETGRLAHLADEQEDVYLVPAFTGLGAPHWNSQARGAIFGLTRGTGIAELSRATLESVCYQTRDLLEAMASDYPMDVRGATLRVDGGLSGSDWAMQALADCLGSVIERSQSQEATAYGVAALAGAQAGVWPDLQTFAANWKAKRSFTPNLNTDERARRYRKWRAAVASTLSYAATA

SEQ ID NO: 170 - protein, 295 aa, Agrobacterium strain K599 (NCPPB 2659)
MSTPDLQHDRVPTADDSAVKFGVSADGFPVARIADTFLAMVPARDGASFLASAWRLTRPLSELTREDFHGHEGRLEDETAFRARVFETARHSHELSALGRIQSRMAATTPWGLSQLATIYAEGIVSHMTAGHGGFHLSAERNARVLPMLRKSLPWYEEDAEWAIVALTFPDLFTSYERKCADETIRNSWPSAWEAIHGRELQPGQSWTKDREAFERKHAGDWIVISAIFSSRHADMTEVIATRGGRRDGRVEEMRFLVPRAEYAARDRFGFVIDPDRHNPCDGPSSFVGWQGRDA

SEQ ID NO: 171 - protein, 199 aa, Agrobacterium strain K599 (NCPPB 2659)
MKSLAQKNVIPFRKNRKVANDRPGINDSRSTPRRHGHDRGRGFPTAIVWAVVIGAAGWLYLDRNGHLDIAAAFVKAPAQDSQSASFVICGDSHRTNCVVDGDTFWFEGKKIRIADIDTPELSPPRCEAERIKGEAAKSRLLTLLNAGKFSLSAGFRDEDKYGRKLRTVSRAGNSLGDVLIKEGLARPWDGARHGWCQGK

SEQ ID NO: 172 - protein, 71 aa, Agrobacterium strain K599 (NCPPB 2659)
MARTMTSDARKKETREKIELGGLIVKAGLRYEKRALLLGALIDVARRIKGDEGERSRLTAIGAEAFGNDDQ

SEQ ID NO: 173 - protein, 188 aa, Agrobacterium strain K599 (NCPPB 2659)
MTAAARARQAITAQQRRAAVILSATTLAAIVLVATALAGGYRINLTPSEPLGLWRIVPLGRPVAVSDLVFVCPPATAEMREARARDYLRSGSCPGGVAPLIKTVIAVAGQHVEIGASVIVDGRVVASSSLAPRDGKGRPLAPFPSGIVPPGHLFLHSAFPGSFDSRYFGPVPASGILGLAQEILTYAP

SEQ ID NO: 174 - protein, 62 aa, Agrobacterium strain K599 (NCPPB 2659)
MAINMRRIRHGKQLTQEEVAHRTGLSVRHVGAIERAEMSATVTVLGQIAEALGVEPAVLVTR

SEQ ID NO: 175 - protein, 283 aa, Agrobacterium strain K599 (NCPPB 2659)
MAASGQSAGLKREEFTMPHRYSSSNRWLACLAAAALTIGAVPSARAGTATGAATEWTQLANNAQLVDLLKSSGLQVDNQLTQISQLAEQIQNQLKIYQNMLQNTAQLPDHVWGQVESDLNQLRSIVDQGQSISFSMGNADDVLQQRFQSYADLKTNLPDNATFSSTYQSWSTTNRDTIASSLKAASLTADQFDSEEDTMSSLRSMSETADGQMKALQVGHEIAAQQVAQMQKLRGLVSQQMTMMGTWLQTEQTDKDLAQARREKFFNAEVKSIPEGQRMEPRW

SEQ ID NO: 176 - protein, 99 aa, Agrobacterium strain K599 (NCPPB 2659)
MANSPSGLQRNRIHRALSRPNLLMGADRELVLLTGLAAVILIFVVLTVYSALFGIAVWVVIVGLLRMMAKSDPFMRQVYIRHISYKPTYKATTSPWRRY

SEQ ID NO: 177 - protein, 233 aa, Agrobacterium strain K599 (NCPPB 2659)
MMMRGASATKTTLRRAKDRQQDVLYDRELEDLPQELRWREWMLRIEAVIFASAEPVSRETLARVVGKDCSIDLLIDDLVEELRDRPYELVSVAGGWQHRTRPRFAETIRASSAPTRGGAAALSEFEAMVLMAVGYLQPITRGELSKIFGKEVSRDVVGNLRGAGFIGSGPRSPTPGAPYTYITTSHFLSVFGMETLRDLPNIEALEDAGLLSRRAVQDDVAFDPTEGEAMFIE

SEQ ID NO: 178 - protein, 463 aa, Agrobacterium strain K599 (NCPPB 2659)
MRMLQSLPSSMAVCMREATPQLKLSGRHLSSRTPKPTSLTEIALAPSLSMGTPGTKNRSLPQLNCRIGTVQAVPHRNANRRFDERELVDYLAEVARLYPEARVWNISANQDGAGLDPTEVSVLGHEISLLARSAGFLPVISVGNVTPDNNSRPNPPADCEAAIVVGGRQALADGTPGDSCPACLPGPGPDGMMKPDLSWFSNLRMLGGVVDTGSSYATPLVSSLAAHTFDSLREPTPDLVKALLINSAERSEHDPNLGWGTPYQGHLPWTCAPGSVTLAWRAQLEPGTAYYWNDIPIPPELVRDGKLFGRASLTAVLRPLVSPFGGANYFASRLETSLAYQSGADRWPSLLGSMKESTLPENDARDELRKWQPIRRHCRDFSKGSGLGFSGPYLRLYARVFMRDLYQFGWTHHSQAGAQEVAFVLTLSSADGEKSIYDSTARALGNFVESAVLNQDIEVSNEI

SEQ ID NO: 179 - protein, 165 aa, Agrobacterium strain K599 (NCPPB 2659)
MRRPASHVLPSCEWRSDDAGRTLPAPVQRLHRDTARYGQHPDAVPALTWKENGTANEGCDKRGCAALGELGRSGNSVLDPAQLRRIEAVHRGYLFQHLYAVQCLLSAATIAAREIAVESDEDVEIQLDGIRIYVQVKHRKDALAWDDIEGAMSRFADLAADSTLA

SEQ ID NO: 180 - protein, 140 aa, Agrobacterium strain K599 (NCPPB 2659)
MDMIQGQQTSGATSIAQWAAVEALNGTQDFIPANKKIFEGRRDLVVSMLNQAKGIVCPVPEGAFYVYPSCAGLIGKTAPSGKVIETDEDFVSELLESEGVDVVHGSAFGLGANFRISYATSEALIEEACRRIQQFCSNCS

SEQ ID NO: 181 - protein, 121 aa, Agrobacterium strain K599 (NCPPB 2659)
MAWLEGYRAPSKFRGLWHRAVRLLAPHVPSVTGAIGWSLFFCEPAAAQAAGGTDPATMVNNICTFILGPFGQSLAVLGIVAIGVSWMFGRASLGLVAGVVGGIVIMFGASFLGQTLTGGGG

SEQ ID NO: 182 - protein, 789 aa, Agrobacterium strain K599 (NCPPB 2659)
MFGASGRTERSGEIYLPYVGHLSDHVVLLEDGSILTMAHISGLPFELEEVEVRNARCRAFNTLFRNIADDNVSVYAHLVRHNDVPVPPVRHFRSTFASSLSETFERRVLSGKLFRNDHFLTLIVSPRTTLGKVGSRFTRRYGKNPGDLAHQIRHLEDLWNVVAGALDGYGLRRLGIREKNQVLFTEIGEALRLIMTCRFLPVPVVSGSLGASVYTDRVICGKRALEIRAPKDRYVGSIFSFREYPAKTRPGMLNTLLSSSFPLVLSQSFSFLTRAQAHAKLSLKSNQMTSSGDKAVTQIGELAQAEDSLASSEFVMGSHHLSLCVYGDDLDTLADYGARARTSLSDAGAVIVQESIGMEAAYWSQLPGNHRWRTRPGAITSRNFAGLVSFENFPIGRKSGHWGGAVARFRTNGGTPFDYIPHENDVGMTAIFGPIGRGKTTLMTFILAMLEQSVVDRSGTIVFFDKDRGGELLVRATGGTYLTLRRGVPSGLAPLRGLEDTAAARDFLREWIVALIESDGRGGISPEENRRLERGIQRQLSFEPNMRSLAGLREFLLHGPSEGAGARLQRWCRGNALGWAFDGESDEVKLDPSITGFDMTHLLEYEEVCAPAAAYLLHRIGAMVDGRRFVMSCDEFRSYLLNQKFAAVVDKFLLTVRKNNGMLVLATQQPEHVLDSPLGASLVAQCMTKIFYPSPTADRSAYIDGLKCTEREFQAIREEMAIGSRKFLLKRESGSVVCEFDLRDMPEYVAVLSGRANTVRFAQQLRETHGEEPSAWLEKFMTRYHEAQD

SEQ ID NO: 183 - protein, 237 aa, Agrobacterium strain K599 (NCPPB 2659)
MNGSEYALLVEREALADHYKEVEAFQSARARSARRISRALAALAVIAVAGNVAQAFAIAVMLPLNKLVPVYLWVRPDGTVDSEVSISRLPATQEQAVVNASLWEYVRLRESYSADTAQYAYDLVSSFSAPTVRQDYQQFFNYPSPSSPQTIIGKRGKLEAEHIGSNELMTGVQQIRYKRTLIMEGQAPIVTTWTATVHYETVTNLPGRLRLTNPGGLIVTSYQTSEDTVSNTTRSQQ

SEQ ID NO: 184 - protein, 376 aa, Agrobacterium strain K599 (NCPPB 2659)
MEDVNAQSREGIDAPGSLVTDPHGRRLSGSQKLLVAGLVLVLSLSLIWLGARSKKRTEPSPPNTMIDANTKPFRPAPIDIPAKPAMTPPAAEATVLPSDQHQREHNELRPEETPIFAYSGGDQNGVKSAPHADIQNGGQDNRNANSLAASEDSAENDLSVRLKPTVLQPSLAILLPHPDFTVTQGTIIPCILQTAIDTNLAGYVKCVLPQDIRGATGNVVLLDRGTTVVGEIQRGLQQGDARVFVLWNRAETPSHAVVSLSSPGADELGRSGLPGTVDNHFWKRFSGAMLLSVVQGAVQAASSYAGNSTGGTSFNSFQNNGEQAADTALRAAINIPPTLKKNQGDTVSIFVARDLDFSGIYQLHMTGGSVKRRHLR

SEQ ID NO: 185 - protein, 1007 aa, Agrobacterium strain K599 (NCPPB 2659)
MTRGRPTSLRTHCLRQPIAGSRESQILSVLVMMTPSRAFVSGQGTGAAKGMRETEGRKGSIMADEEFRRDFSRSATLNSNNEGATGAPIPDTSVSTAFRQNRREHLTTSSLRPLITGGAGDLPGTSPENQRPTTHAPNTAEILPVRSAEAPAGQSAVFPRSKGYFRTAMQYLREIEMQSTARADHEATSSSRFGKGERKQLREHEQTGDQSESMAKRSTSSGMQVGTIAASLAMKDSSTATPASQGPHRSGMELDNIEGTGESRTQSQHEIATQPIATSAFGSGHDVIIPGEGQPEETFDGAPYWMVESGDSETNSLPSIQQGLSWPGLDDLDLLADSSSPLSTQVVPPDVAATNLSTEAGSASVESTQILADSAYSDDATETGGQTASGSIHEGSVRSLGSPEERFDAFPELTDEDLAQIDAFSRARSPSRRDAAHAIHAVSLDDAFSRKDLAAGHDGRLTNPAFRQEASLQESSPSETKSDDFPELTDEDLARIDALSEARSTSRLDVARTIHAVRLEASRQDPSPSEMKSDDFPELTKEDLARIDALSGPRPTTGREGANTIQPVRLDDAFSAEDYTVGRGGRHTNPAFHEEASRQDPSPSEMKFDGLPELTDEDLVRIDAISEPRSKRSRSEQVVGGKSHRLKLNEAIEEAGSPTTVSGTSAARAAPITLESGVPRLPQATHTELPGSDVAGPLRIGKASCADIRRDVSDKGKRKVSSDYQIQQGPGASYAYQPRRMPTEAIFDAERLGDEVLIGNEPVPRWPYPWEHVVRFETGKQLFERLQKWPTAEELENSVILVKADSAQRSYMPRNQLLLHLGSEKYYERMKALGLSDNTFSGLKSDSKYFYDTPAGPRVSEHDYEFPRQAGVHNPEVMVQHHSGTFFAFWPKLLRLEKLATVTNTYGAENVWLKSPANAYMTPETYNSKVANGAENLFIEFLRPAPVHDHLREPGTSNAKTVDGRNEDRAQQADRLADQSMGRNGDGRDAQGGKRTLEPRVRERYGL

SEQ ID NO: 186 - protein, 835 aa, Agrobacterium strain K599 (NCPPB 2659)
MKPSGSSKTGYAGSARSSPQVRAGVTPVLHPKEPWNRFACSPSDGQMDHRENLSAQFAYDGMRLGAAERSAYETWDRADRPSWKDLILSARLNAIDSFAWNVDVGESTSSTFVYDGVPLAEGERHAYEEWVEPGQPSWQQLVVNARIEELNTSAAIPNECSPLQEEFRSEAPKRKRTSSIGQKNGFPEPFEFDGMRLGSPEREAYENWSKPQPPSWKDLIVDARLDAIDTSTWLNESNDTSVFEYEGVPLGEGERLAYEKWLKPAQPGWEDLVVDARVAELHQSAPTWCEHQPGNDVSSNESGRISGVPINAEQVSRAFFVYDGVALGAAERAAHDRWSRPDRPTWEDLIIVARQAAIEGGAVSNGMIGKTSSSVFLYEGMLLGDAERQAYGRWRQLAQPRWQNLVVNARLAELDPAAWIPDEHDPSEDGGATGLLSQASTTNKSRLSLGDQPEARSPSLAREPAQQPTHVQNLTCAQLEARRALYFGPSGRDADQTASIADSNRLDEVSKVKRLGAKSRRGAKATAYDVISSAERLSSHEGCLTVQSTQPEKAACSRSDNIGTYGSRKNERARLATETGKYESEHIFGFKVVHDTLRSTKEGRRLERPMPAYLECKELHRQHVGTGRGRTRLVGRGWPDDASYRSDQRATLSDPVASTEGATASNGYQLNQLGYAHQLANDGLQSETPDGVIMPLQVATTSYNYTVSRDPVLSPPSKEQAPELLHLGPRGQTEAVLARETALTGRWPTREREQQVYREFLALYDVKKDLEAKTLGLRKKKAALVSALNRTAASIGTSPLKAQSSSAEVEKATHEFDERRVYDPRDRGRDKALQR

SEQ ID NO: 187 - protein, 252 aa, Agrobacterium strain K599 (NCPPB 2659)
MSRLRTALNRYVGMRQGLGYKYDGPARRLSAFVTFMEARGAETITSDLAMQWVTSMGRQPSWSIRLADVRCFAQHLSHFDLLTEVPPSDAVPPARRTKPYIYSDIEIQALLAAALSLPPANALRRWTYHCLFGLIAVAGLRHSEALGLLRADVDLEQGVLTIRETKFGKSRLVPLHATTIAVLTNYAARRDAHAAACRAVPISSSPNRAADCCINTCTGCSGDYPGKLVYGRRGIAVARGFTIFVTVSPSKP

SEQ ID NO: 188 - DNA, 21052 bp, Agrobacterium strain K599 (NCPPB 2659)
  misc_feature (1)..(2146): Agrobacterium strain K599 left T-DNA flanking sequence
  misc_feature (376)..(1392): rcorf148, similar to mll6374 integrase/recombinase from Mesorhizobium loti MAFF303099
  misc_feature (2254)..(2700): complement of rcorf2b, similar to riorf2 in pRi1724 which is strongly similar to a Rhizobium sp. pNGR234a nucleotide sequence.
  misc_feature (3515)..(3734): left T-DNA border from Agrobacterium strain K599.
  misc_feature (3613)..(3636): left T-DNA border repeat from Agrobacterium strain K599.
  CDS (4727)..(5551): complement of CDS1 from pRi2659 T-DNA, similar to riorf11 in pRi1724, COG0561: Cof; Predicted hydrolases of the HAD superfamily [General function prediction only].
  CDS (4727)..(5551): CDS2 from pRi2659 T-DNA, similar to riorf12 in pRi1724, homologous to orf3n of pRiA4.
  CDS (7477)..(9819): CDS4 from pRi2659 T-DNA, probable tryptophan 2-monooxygenase (EC 1.13.12.3), homolog of iaaM and tms1, similar to riorf13 in pRi1724 and to orf8 in pRi8196.
  CDS (10619)..(10900): CDS5 from pRi2659 T-DNA, probable rolA, similar to riorf14 in pRi1724.
  CDS (10619)..(10900): complement of CDS6 from pRi2659 T-DNA, probable rolB, similar to riorf15 in pRi1724 and to orf11 in pRi8196.
  CDS (13315)..(13857): CDS7 from pRi2659 T-DNA, probable rolC, similar to riorf16 in pRi1724 and to orf12 in pRi8196.
  CDS (14553)..(15149): CDS8 from pRi2659 T-DNA, probable rol gene, similar to riorf17 in pRi1724 and to orf13 in pRi8196.
  CDS (15614)..(15886): complement of CDS9 from pRi2659 T-DNA, probable rol gene, similar to riorf18 in pRi1724.
  CDS (16496)..(17062): CDS10 from pRi2659 T-DNA, probable rol gene, similar to riorf19 in pRi1724.
  CDS (17371)..(18162): CDS11 - complement of cus gene from pRi2659 T-DNA, probable cucumbopine synthase
  misc_feature (18557)..(18747): right T-DNA border from Agrobacterium strain K599
  misc_feature (18571)..(18594): right T-DNA border repeat from Agrobacterium strain K599
  misc_feature (18598)..(18739): 8 bp repeats of overdrive equivalent from Agrobacterium strain K599
  misc_feature (18969)..(21040): right T-DNA flanking region from Agrobacterium strain K599
gcatgccacgacaatcgctgtccttacaaactatgctgcccgacgcgatgcacacgcggccgcatgccgcgcagtccctatttcttcgtcgccgaacagggcggcagattgctgcatcaatacgtgcaccgggtgttctggcgactatcccggcaaattggtttacggcaggagggggatcgcggtggcccgcgggttcacgatcttcgtcaccgtttcgccgtccaaaccctgatcaactggcatcgcgctggcgaagatgtggaacgcgagctgccggtactctcgaccttcctcggccatgccaatgttcgcgacacctactggtatctgtccgccgcgccggagctgatgaatcatgccgttcggcgattggataagcggtgggaggttcggtcatgagacgaacgaacgacttagccgtgctgatcgagcggtggttcacagatcggctcatgaagcatcgaggtgtaagttccaacaccattgcctcctatcgagacacgttcaggctcctgtttgcgttcgcgcaggcgcgccttgggaggtccccatctcaattgacactgcgggatttggacgctccgttcatcggcgcattcctggaagtcctcgagacgcagagagccgcctcggtgaggacccggaatctccgcctcacagccattcgatctttcttccgatatgcggcgttcgaggagccggcacatagcgcccacatccagcgcgtgctcgcgatccccagcaagcgatgcgacaagcggcagcttcagttcctaaccaggcccgagattgaatcgatcctggactgcacggatcgaagcacgtggctgggacgccgcgattacactctgctattgctggccgcgcaaacggggctgcgggtttcggaagtcatcgacctcgaccgagactcggtaatgctcggccgcggtgcgcatgtgcaatgcgtcggtaagggccgcaaagagcgaagtacgccgctcacaaaggttgcacaggaagccctccggcgttggctcaaggaaccagggaagcgaggcgcaacggctctctttccgaatatgcacggtggcaggctcagcgccgacggcgtgcaggcactggttttcgctgctgtctatcgggcgcgcgagcactgcgtctccctccgctcgaagcgggtgtcgccccacgtcttgcggcacagcgctgccatggagctactacaggcgggcgtcgactgctcggtcattgccctgtggctgggccatgaggcgatggaaacgacgctgacctatcttcatgcacatcttgaactgaaggaatcgacactcgcaaagctgaagccgtacgaacgcgccaaggccgagcgatttcgaccaaacgaccggcttctggaattcctgaacgccctctgagcatgagaactatgccgagtgccaacgacgggtcttcgaccaaaaacggcaagagaagcgcgtttcaactggtaagttggaagaggtgctcggcatagttcgccggtcggcataaaccgccttatgccgcgcgcggcataatgctgtcatgatcagtgtcgccatgaaggcggcgcgatcggcacctcgatccgatccggcgaagagccatgacttcctcccgagagcaaagcctctcagcgctcgttcggccgcgttgttcgtgagacaaatcctgccctcgtcgaggaaagacgtgaagccgttccagcgcttcagcatgtagtcgatcggctcggcgactggagaactgcgcgacagttttgcccgttcggtttgaagccagcagtgcagttcgccgacaagcggcaggctgtccttgcgacggcgctccaggcgttccgctgcggcaagcccgttgatctgccgctcgatgtcgaacagggcatcgatccgtttgacggcctccaacgccataggcgagatcggtgcggcgcggctgccgcgtttggcattcgtggcgatgtcggccagcacgaagaacttgcgcctcgcgtgcgaccagcagagcgcctgcgtcagcggccccggatcgcggtctaccttgaacagcggattgtagccgccaatatgttctgccgaacatatcgggggcttgttgcggccgtccatatgtggccctgctgacctataccctttgtcaactgagtatttgggcccgatttgacgcaacataaatcgcaagtttggcagccggaccttttctcgtttggaggttcgacatggatcacccttccttttccgaccaagccgctgatgccctatttaccgaagtgccatttgctgacgagcggaaccgctatttgcatcactgcgccacactcggagcgagacccgaagttctcagggtcaaacgcaacgaactcctgtggatcgcgcgacatctcggtccagaggctgcggccggcgtcggcatggcggagttgttgccgatcgcgcaggctcggcagaatgttcacggtgcggctaccgctgcacgtcgggtcgtcgatatcgggcgcccctggctgaagttccttggctggtggcgtgagcccactgtcatattgtcgtaccaggcgcaactcgaccggtatgttggctggatgcgcgacgaacgcggattgacatccgtcgacggtggaacaatgggggcgcatagccggcagattcttgctgtggtgcgaacagtcgagccaccggctcaaggatttgaaggcagaagacatcgacaactatatagcgacccaaggggccggacgctggggtcgtgtctcgattgcatacatcgtctcagccttgcgcggatttcttcgatatgcggcaaaagaggcttggtgctcagaccgcctggtgtcgtcaatatcgcggcctcggctctatcgacaagaatctctgccatatgccccagactggtcggacgtccaaaagatgttggctgatgtcgataccgaccggccccgcgatatccgagaccgcgcgatcctaatgttgctggcggtatatggtatgcggcgcggcgaagtagccgcgctgcggctcgaccaaatcgactgggcggggcgaacgcttcggcttttccgcttaaagcgccgacaagccccagatctatccgctggtgccctccgttgcggaagcattggcacgctacgtggacagagtccgcccgccgtcgtcgtgccgagaggttttcctccggatgcaggcgcctcgacatcccttaggggcctccagcatttatagcgtcgccaatcggcgatttgttgcgctcaactttatggaccgcctcttaagggcggtggagcgtcgtgaccggaagaagttgaccgacgtgcaagccgtcagcggttgcgcaaacgacgatgatatccgtctccagcgcagtgtcttggcccaatgcctgattttatacagccgagttcaataagcgaagtggcgcacactgtcatcagaactttcctgccaaccgcccgaggtctccaaacgaacaaaaccgccttacaacgggccttgcttcaagatattaccgaaacgtgctccctcatgaaaaggtcgcgaataggttgcggctatcatcgctcttgatcatggcgcacctcataagcgacccaaggcaaagcacgatgtcgccttatgtggggtggcaggatatattgtggtgtaaacgagctaagtacaagagctttgaagcgatttttgagcacgtttttgctatattaccagatggtgtccgggtatgtttaaaagtgattaatacagcctatctaattacaatttttatttaagatattaaaataataataatatccgcgcctttaaataataaaggtgaaaattttatcgccaatcgtcgtcgtgcaacaatacgtgagcctgcacttattttccaaattatataaataggaaatacaagcagattggagcaattagaaagggcgccaataatattcactactaacattttataaaaagaacaaatacatctgtcgactatgccgtacgagttggtcgggcaaagcggagactcgccacaagttgaagtcgtgagaggcgatgggcacatcgtcagagctgagtgcggcatcgagctcggaaagattgcgcctgcctatctctccgagagcagcgagcaacgacgtttcagtgcattcctgtactcgctttccgagattgtacatgcctctgtgttcgatgacttgaagaggcagagtctcttcaagacgttcaaggaggttcggtaccgagtgccgggcgagacctcatccgccgtgacaccatttgggagatcccattcgagcttccactcgggccaacatgtgcctttcacggggaacggtttgcgctggcaaaggatatcgttttccatcggtttcggaaggctgccagataaatatgagcttttctaaaaaggattcttgtaataattaatccttatccggcgggagtcttaagtacttaatgatgttgaaagaatttatattaaaaatattctattctgaattattgattaattaaataaagtatataaaatataaataattttcggtgaaaaagattccatagttatttattcaataatgcagtggctcatggagatattatattatttctggcgttgtgtattgaaatagtcgccggagtggcggatcatagacactaaaatagaaaaaactaagtaacaactgaagcaattatgacttctttcccttcctacggtgactatggatgtaatagaacagcggcagatcggagcgatcacttgctcagatcgggcaacaacacgccgagatcgccaagaattgcagagagagcatcctcattcggtatggcgaagacgttggttccagtgggcttcgtctcacgggtaccgacccagaacgcgataccattctccttgttgccaacagcggtcagcatatctttatcgttttcgccgttgccgcacgctatatgtaggccgatctcacgagggagtagattgacataagcaaaatagcctttgcgcttgcctggcgtttcctcgggcataacgcaatgaccctcgggtactgcggtcgcccggaaagagcgtccccaggaatgatctacacgcggaagaagcgatgaaagcagatctccggccgattggtaacgtggatgagagtcccacatctgacagccatagaaatgctccatcggaatgttgcggatttctgggttgccgccaaattcgctctccataaccgcatgaatgcggctccagttgggcaggggaacggattcaaaacgttgacctttgaagattgtgaccgttccgtcattcccttgaaaatcaatacctggaatgtctttgaagggcgacgagccgatttcgccgcagtggcgagcggacgtcagcagtaggtaatgtcccttccgggcgatcttggtcaaattgtcgatgatatcgatggcaggagtaatttcccagcactgaggctttcgatcttgcttaaaggcggtgccatcaccatcgaaggcgagcagaacccggagagagggatccgtaagaccgcgtgctacccgttccgcgatatccggaatgacctcaacaagagacatattcaaagctggtgtaaatacgatctgaatgaagccttaaatgtaacgcagcgcggcaagcattagttgactttttggtgagagaaataactcttagcagggattagttggccagccattatcaatgtggggccaggctgacaatgtttgcgtgcaaggccggattatgtcgatgtagacctgcagacccgttgacttcctataaacaccgccaatcatccacctctccctttccaaggtcttgccttttttgccttgctaccatgccagccagcgacgcgatgtgcgctgccgcggtcgccttcccggagggtaactggaagagagaactcgctgcgctgcagattttgcatgatcctgtagatgtgattacggccgctgtcgccagaggtcttagcggcatatgtaatgtcgttgctgcaatggatgccgaaaaagtgacaggcctcggcgacgtcattcggcggatgcctgctctaaatcaccgaattgccgtcgccgccggtgaaactccagtgcgagacctcggaatagggtaccagtgcgcaatctgccaccccgacatagcaagtgctatgttagccacttccgacgggatcagccatgctgtccgtgaaaagatcgagaaagaagttgctcaggatattggagaaggtgccatcgtatacatcttcattcagccgaggatgagttccagcaactctccggtttctgtccatttcaccctccagtttgcgagttctggagctctcgtcgaagccagaatgatagagagttacaattttatgaaaggcgatggcacagtgactgcagagaaattgaaaagtcattggaagcagcacggtattcgcagaccaagtccacgtccgcccaggtccaaatttgaacttcttttcgctccggtccccgacaacagtaaacttgccgccgccgatttcacccatctcggcttggtcgagcgggatagagaattgcttggcagtacggtcttcggaattgccgccaataaacctgggacggtagtttatcagtgtgacaaggttctgtgtctggaagtggatgtcgagtcacaccgcgcgttggaggtgcttcaccgccttggggagcaggtatatagggctggttggggcacgagtttcggtcttcacacaggcccttcatcttgtcttaatctttccgctgctgcactcgccacctttttcaaacggactgatctttgttccgtccctgctgagtgatgttttttgtctcttctgcgaccatgccagccgttcgtacgccgccaaagaagacggacttccactcaccgccttctccctcgaaaatgaaagtcagtttgaactcgtcgacccccaggttgtcagaaaatacgttctcggtcttttcgacgccccgacaatggttgagccccgcgatatcagcagagcgagcttctgcagccaatatataactttccgggaaccacatccctgtaaggagttcaatgaaattggtgttctgatcctcgatgctgctgctaaaatgctcgaaagttatgccgaattcctggaagacgatggaagcgatgataatgaaattgcgagcgttaaagatgtatttggcttaattgataggacattatgagcacgatacaaaacagaagcagtaacggaagtttccaatgtgtttgatatttgtgttgccattgtatgttgaattccttttgtcaatcttattgcatgttcgaaattgcataaatttgggccgtaattttccgacttttttgaattttcgttcatctctttaattgttgatgttgtctagggagacagctttattgaatttcaatgacatgtcgccatttacgtgtacatcagaataaaaagataattccggcaaatagtttcaatttatatatattacatccagatttacattaacaaagcatgccttctataaacaaaaggaaattctatattctctcaatactccatatctacatgatggatcttccctataaccgcccccgtttccccccgtttgctatcaccggtctacctagtgcggccaaactgaaacgagcaatttctcgggcctttgtctgctatgaccagttttgcgatgaactcctacaatatcagcaaaggtggacggattgggtgttcgaccacggatttgcagaagccatagaagacatggctctggtgttccagattgaaccttgccttcatggtccccgaacaggcacactggaagtgctgagatcttgtcgcacgaaggtcttcatttatacgtcgtaccgcaggttgcgccactttgttgagaaccagtgcattgctcaacctggcgacgccgtccttgcttgcatgatcccgccctacgtgagtgacctctcactgcaggaaatgtctcgagcccacaatagtttttgtccaggcagtcacacgagcattgcagacgtgcagtgctttattgccatccaactcagcagcctatttgttgaggagggtacatgtgatgtgcatgggcgaaatggattaaaaacaacctgccgcttctttcgtcgtcccgctgagtgcttcagccgttacgacatagttgcaatagggtctgtgctctttcacaacgcattgcatcagccagcgaactacaatgaggatctttcttgcttcgatctgcggtacgactatcaggttttcctccatgagcgcgatgccaatgatggtgtggggcattatccggaaggcacaccactacctagtgtcgccatcgtaggtggtgggctctctggccttgttgctgctgcagaactacttgacgctggcgtcagggaaatagccctttttaccccagtagatgaggttcggagtttgggtgtatcgccgatgtcaaacggcgacgctcgccaggtcttgacgtcattcggtgtcatgcccatctccggcaaccaagtttgtctgtcatactatctggataagtttagaattccgtccagccttcgttttccttgtgccggcaacgatcacacagcactctacttccggaaaaaacgttacgaatggccggctggacaagctccaccaggtgaattccagcggatatctgcagggtgggagaaactactataccacgggtgtgaacggaacggcaggaggctgatcgctccgatggatatcttttccatgctgagaggtcggcgttatgaagaagcctcggaagcaaggcgggcttggctcagggagtttgataatttcactttccatgccgctctggtcgagatcttcagctgcggtgtcgagagtcctggtggggcggcatggcaaacaactgattttgctgctttcgggatgatgagattgggcggcggccgagtttcttcctgttacaccctactgttttcgacagtcctggactggataatcaatgggtacgaggaggaccagtatatctctgttggaggggttcatcttttgcaggctctgatgcgcattgagatattcaagagaaaagtaggattccattttgaccccctgcgtggactagccaaggagggcgggaaagtgaaggtatgcatgaaagatggccgttcgcgcgtttttgaccaggtcatcattggcgggcgaggtgggcccgatgcaactaatatcactccggttagccatgtgacctgtgtcggctatgatatcgaagcccccgctggaaactcgtctgctactgttaacgcagcacttttcatgatcacaaagcaaaaattctggcttgatgacgatatcccagctttgatctggacggatgggctcgtccgtgagctctgttgtattgacatcgaatcgccatcgggagaggggcttgttatttttcattatgaaatgaacgactatctatcccgcccgttccagtccgatgagaagaagagaaggtgcttggatttagtcagagaacttgctgctgtctttcctgaattggcttgtcatttggttccagtcaacgaagattacgaagaatatgtcttcgacggccacttgaaggatggtttcagggcctctttatggagggaaaattctcttaaaaaatgtcagtacagccaagatccgcatatgtatgattctccgttaatggagcatggggcagtttgccagattgacagtaaggactgcgtaaacggagctttgttcgaagagcaggttaagacgggcatcataacggcctgcaccgtcattcgcagcaccggcgggacactatcttcactccatcccctggattggaataaaatatattttcctgcttaagtatattaatgtattagtgcgtattaatcccgtaagcctgtaagctgcagtagcggcgctcaacttagctttccatgaataataatgtttttcctttatttttgattgaatcctgcttaaaaaatattctttgagtgggcttaaaatgacattaatcagattccaaaaatttccatctgtgaccattagcgccttgatcgatgacattaaagtcttcacatctccagagaaagccttcgtgattgcttgtctccacgtgctttcgcatcttgacagctaatagcgggccccttgacacactagccggccacgcaattcgagatattcccactaaccccaatgaggtcactgcattcgtcattggcagccgccccacttgcattcgccactgtgccgtttggggtccactagccgctaattaggactgcatatattttggacgagctaaggggtcactatcaccttcggtttgaatttccttttcacaagactttaatgttgccaattgagcaggctgaaagaaaatccgcaatcaacggagaaaggttaacagccaaacaaaaaaagaatgcttcatcattgcatagggtctacaacgaccattactttcggcggtgggccttctactatttttttcttagtcttcggccagccatttgttaacttcctatatagatcgcttcaccagaagaatgaattatttagatcatgctgtaatgcttcaatgctgtaagttctaaatgtttgtttcgttttgcaagaaatctattttgctaacagcacttcttttattctcaggatggaactagccggaataaacgttgtcggaatggcccagacctttggagaggcctcgctcgttgtctccgacctatttcggcgggctaaggtcaagaagaagaaggccaaacgtgtgtcgccgggcgatttcctccctgaccaaattgcagagcttgatgatctgagcgtcactcctctggctataacttctcctgggcctcccgtgatggtcaatgatcacggaattgccacgaggggacgctttgtcgctggaccggaatattcagacctacggggttaatacgcagttctaaacaaacctacgggaattaatacgcacgtggctctataatttcgattcatctcgccgccggagatgatgtcggctattttctcgttggtacaataagttgcgagccaccgtgcgattgtttttaattttctatatagtactttaacgtctctctatggcgatttgtaatgtttggaatattattgtctgttaaggcgcctttgtaacaatatcaatgtaaaagcattatcagtattgtgtgagatctctataaatatcgaaatgatttgcctattttctgaaaattggcggcagaaataatgctgtaataatttatttcaacacaagtaaaatacatcgtggcgtacgctacacaactcctaacaggagcatagggctacgccggaaaacatagaaatcctaccaaacttatagttaaaggtggcctgcaggggacctcaagtcgccgaggtttctttcttcagatttactatagcaggcttcatatcaccctcttcacgtttctggttgggtcccgagagccgcagggtgaggtctggctccggtgacggtaccgccggtcgtggcatcacgccagcatttttggtgaactgtgtgatgccgcaagcaatgacgtcataggagcggtttccagtgccttgccgcacgaagaaggtgcaggctacctccctgccgtacacatttgtcacttttaactccagcaggtgaatgaacaaggtacttgcaaaaatggcgataaaaccttccagatcaggttcttccacgcggcggtgcggccaagcaatgttgtgagcacggaccatctcctggagggcgaggtcgctacgatagggttgcatcgtggtcgccagcacggcctctaatccaaacgtgatggatttttcctccagtactttctgcatcttctcgcgagatagatagacaaatacatgtcggtcgttttctctggccaaatccggttgatcgacaagcatggggggatgataacatactttgttttttagaacgatgggccagttgtttaagtatgaccaccggcgacggttttcctccaaatcaagcacgccttgggcccaccttttctggaaatccatgagagttttgctatagacttggctatagattaaaaatgcaaattggatctcattgaacaagttaagctggttccaggcttttgtgagatctcgtggttgaaagcgttgaaggaatagtaatcgaggaggcattgtgatgtgaggttggggataactgtggaataacggcaagttcagtgccatttaaagtacgccgccggcaagtggcatcaatcagccacagtttccggtcgggaaagccagaggcaatctggcaataatcaccatcgcatcaaaatcgatgctcggacatggcggccttaaaacctggatcaagcgaaaaataatgcctgcttgattggtcacgaggtcatagtagtgggctagcatttttgtcttttttgtttggctttagtgaaagtgtatctaaaagatacctgaaatggggaggggtggggtagagcttaaagtttgccgaatattggctttcgtgaaagctgcacgggcaacttgttgatggttgcactctcgatgctatttataattaagatgtaattattgccgctacgtgtagttattgccgataatatcataaattctattgatgtatgtggtatattttgaaattgcatatgtctgctcatacaaataatttatttcaattacgcaattactcttatgccaataaaatgtggattatatagcaagtgtaatcttaaatacaatttggacctatacgacttaatattgccacgccaggcaaccagtccattcggatcttgctataagtgccatactgatacaagttttagatttgaagcccatcaatcgttttagagcccaaaaatcaaaatgggccgaaatagcatttatctaaaagaaggaatcgtggctagttaagtgctttgaatgagatcccatggaaaagcgacacctgtgtggtgcagacaggcctaacgtggtgcacaggttgaaaaagtagtgccttttcgcagcataaataaaggtaggcgcgtgcgaccataattaaaggaaaaagaaagatgctattgacgatgtgacaccattattggacagcagaacctattcccactcgtgcttttgcaaagatgcaaaacccttaaaggccattttaagtacagacacgtgccggtctataattattttacaaatgtgagacgtggaacatcgatagtcgtataatttatgaatattgggttttgcagctatacctaactgatattcaactcatataagcaaaagcatctataaagggaatggtgcttccagttctgggtgcacgccactattgtttcctactttgctaacatggcggaatttgacctatgtgctctcttttccagtcttaaggtaggcgacgtatcgtccagcgatgagctaaagaaacacatccagagcgcctcaaaggagcggacccccctgacggagccgggtgagggccagtcgatggatgttgacgaagagggcggtcgccaagaccctgggatactgtacctctacgtcgattgcccgacgatgatgcgatgcttttatggagggtctttgccctacaattccacgcacggcgcgctcatcaccaatcttccaccataccagaaagatgtaagtctcggtgaggtgtgcagggggcttaggcaggcatcaggattctttggatacgaggatgttatccggagcgcctacttcgccgcactttctgtccccgggtacttcgtcaagctggatgggcagatggaactaacttcaacaaagggaaagtctctgaccttcgacctttatgccagcaaccagctcaggctcgaacctggtgcgttggtgaggcatggcgaatgcaaatttggaatggagtgatggcagtagctgttctgacggtgcccagaggctggaggtggtacctgtttcacgctagaaatataaatgtaataaactcatggatctggttgatgtaacctgcgccatggatgcacttgttcttttttggttccgatggatgggttgtttgcttgaaatgaaacctgcctgttcgaaatttggttatcactttttccatttatgtttttaattatttgtgtattaaagaaaatagttcacatagccgcaatatatgaccgaagctggcccgcaatgccgcaatagatgattaatttgtcaaacttagctatcaatatctcgatagaagtgcccacatgtttaaactaggcaaactcgttctccttgaaaactgataataaagacaagaaaattagcccactctaaaaagtcacatagcaaattcaacataaagaaaccagaagtcagaggaaagacttttaatccttgattatttgaacgaaatagccgcaatacgccaaagtgtcgccttcatgattgttcaataatttctgtagcaaatggaaaacgttttacaaacaatgtggccttggagtaataatcggaagaaaagttcataagtcagataatttgcgttgctgacactagtgaccaagcacctttaaatacctctgcttcccatgcatttttccaagttaacctaaagtggcagttgaatggctcgttatttcggtggtagctctcaacggcttcatgtcgatgattttcgtttgatcaaggagcccactcgactgaaggctcagcttgttaatgtggtggaaacctacaaggctgcacaaacagagacgttaaagtactatataccatctgcaactgagcgtgtggctcatatggaggcagtccatgtcaacaatgcagaaatggggctgcatccggccgggttcaagtatcctctgtccttcgtctttacctccctggccgtggctaaagcctgcaaggagaacaagcatctcgtgtgcgaggagcatttggagggagatctgatatcgtgcgtcgttcctccctatcagacaaatgtctcactcgctgctttaagggagatccacaattccatttcgggaggagggtaccggaatccaacagacatggattattttgtggcgatcttgccagatgaaaatttcgactatcagagctgtgaaattgtcaccaaaaatggcggcgaaggcctttgcaagatttatagcagacaactggaggggcccttagcttatgaggccatactggcaattggcaaggtcctgttggaataggcagtgcaccgctgatccaacgggagtttcgattatatttcgtattatcttacatgacttaagatcatgcatgtttcgcttgttctcccgtgtgtcggttacgttattgtgttaaaataacgggatgatgatatcaagtgctattgtaaaatatgttatattttgaatatctataatataagcgctgtgtgcgctcgatgggtagttaaatgatcatgatatatatttttgggtaatcaatcgcattgcagtgccgtgtgcttattgaagtaatatagtgttaaaattatttatttaatatctgataacatatcaaagggtacaacgtgataacaaagacggtggatacagcgtttattgggatatccgctggccagttatacgtaaataatacagacagagtttgagagagcacgcagattgtagccaagttgagtgacttgccggtagcaccgaagctaagctcaggtgttccaaattgactggcgtcgaggtgacgagcacgacgaccttgccggacaatgcggtcgcagggggctcaaggcgggtggcttgtaacggaccttgtgcttcttgttgtagctttcgttgagcataaccattgggaaggttgctgaacaacggtagcgcacctttttcaagcgagggtggcagaagaacatatttgcccgtcggcagacggcggtgagcatgacagctgctaagggagttactggaatcgcgtgagcggtgagcatgccgtcctgactatcggcgcccaatcaacaggacatcctcaacatgttttccaattccttgaaacctatctttatagcattgatctccaaccgatctcgattgaggccaaatttaatattcaaaagagagtttagtggaaatggaatataatcccgtggcggaagaagagccttcaaaaatggcagtccactaggacagtcaataatatccaaaaagcattgaaattgggttgggcacgagaggctgacgcggatgccactcgattgctaatggagtggttccttttctagcatatcgaatccatcgcttcactatatccttacctgattggctgagctgcgagaccaccaataacttccactaatatcgaaagtgtggctgctttgattatgatgctttgtgagaggttctctccccaataaagtcaagttgacagattcggatacgcccggttgagattttatttcattttttatctatttcgcatctcgaaaagttcacagaaatcaacaaggaggaggccaggtgtttaaataggttccagctgctctaaagtgatcagaagagaatttacagctggaggcacaaagcactaatcctgctaaagcatgagcatggcagatgagttggagcgtcaattggaaggcatttctctcgttacagtcctgggtccggatgtgagggccgagcttgaggcggcgctacgggactaccgcgatgatctcgacttctggaaaaggaacggttacgcggtggcggatctcgatcaatctgtgacggtcgacaagcttctttttatgtatatggatgaaccaatagcagacttgtgtgtaaagaatcgcatcctcgtttgcaacagcaattcagtcgcgaaaattacttcgcttccaccatacctgcctggggttacaagggccgaggcgtttgagaaacttaactccattgtttgtggaggtcctgcatctggatctcttcaatctgcttgttgcgactatttcgtggcgttcctccccagcaattgttttgagaagaccggtgagatatcggtgcgcacagtggacggcgagtgtggccccttcgatgtctttacccggcagcgtcagccagaggatcagagcgatatgttttttaagtatgaagagattgtatgtgctggaaagagtctatttttttgaaactagtgtgttttatctgtgtaacatgttatggagtctgatcgtatgatgtaatagctaaatttggtattaataatgattgatcgttatataagaattgttattaacataattaagtttagagtaaagcaagagggaaataaattaaaacactttattcagttacaaacaattatgaaaatacaaacataatacaaacataatacaaacgtcgcaggagaaagatgacaccgtaggatatttatgagccaaggatagacttgccagaaggcgagatcgtcctcatagcttagtgccttgggcgggccctaactggtgggctccatcttgagaaaaaacagctccttagtcaggaaggtggcttccagaacagcgcgaccaaccttatagatatcgtcggcatactccggcaggatctcaccgagaaccggtgtcgcaatatcttcggtgacttcaccatactggacgatgaccttgttgccggtgccctgggaatagcggatacggccgaccggagcatcgcactgccgttccttgacgttaacctttgcggtgctcacgacaggcgcccacgcgtacatggattcaccgctgacaacggcatggtcctgaacaaccgtgaagggcagagcttgaataaggtcgttgcagagttcggggttttccgttcgtcgcgagataggcaatgacgctgatgcccagcggctcccaggtaagccgtaccttttgaccgtcgcggatctgaacacgccgagagggatcggccagggccgcgatggaacttccggggtctcgtaagtgagatgttttccgatgctccaagggaagtaatggaatgaccaggcggccaaacggttgaggtaacccaggaacgccttgacggcctcaaccgcctcgtcgcggctaccagccgtcggaagatatttggtgatcgcttcggcaaaagcgcccatttcctgcaagccgctgtagcgcagatagttgctgtatgcgtagtcaaagcggtgcacgagtgcgcagcactgctcgagggtaaatcgctcatcctggaacgtcagcagcaacggataccacgtgtacatcgactggtcgcgcagcatgccgttcacgaagtcgaggttcgtgaagtattggttgtttgtcccgaccgcgaaggtgccggtccggatatcatgaagctccttcggtctcgatatggaggattgcctttgttgaaagcgtgatctctgcaacgagctgtcggaggtcgggagcgacttgcctgcaggccatgtgttatgaacaagaaggtggaagcaaatagatgatgttaggaaagggtgggattgcagggtgggcaggcacgatacttatagtggaaaaaggtatggagcaatttcgccgaaatctgggtgggccttctaaatattgggcgggccgcaccgtaactataattgcaggggcccaccaggttaattgcgtggccgcgttgattgggtgatattattacctaacatgagattgttatttgacaggatatatccccttgtctagttcgtcagttcgtcagttcgtcagttcgtcagttcgtcagttcgtcagttcgtcagttcgtcagttcgtcagttcgtcagttcgtcagttcgtcagttcgtcagttcgtcagttcgtcagttcgtcagttcgtcagttcattaacattgctccgcgcttgcctgatttgagaggttgtctctgcacgggtctgcagcgacatatggctacgaggacctaccttgccgatgagccgtatccatccggcgtagggcggggtttatgatctcggctcgtctgccatgatgcgttcgatcctttcgggatcacattgctcatcgacgcggaattgccggacaccgccctcgcaggtgcggataccggcgaggaattcctttaagctctcgatgccccggtcggtgaaggtcgtgacgccctcttggctgccgtcatgggcatggatcatctcgccgtaatcgatattgtctgagttgctggcgatttcctggaggagttcgaggttctcgccgatcagcgaagcaacataatcgatcgtgtagacatgcgtcgggcgcgctgaccttgccccgttgtgagccgctaagcgcattgtcctcaccaccagctcatgtgctgtaacgcgcgaagctgtcgcaggctgtaccctctataagttaaggtacaactctgccgttggatgaattagcctcctgaaacgcttcctttacgtggctgatcaaagcacgttcagtctcgttaagcggcgtggaggtggagaatattgcccatagtcgccgcggcgggactaaatggtcgagagagaacgtgtccacgatccctgcctcgatctccttgatcatcaccgacgctggcaagatcgtgccaagaggtgaacgacgcaaaaccgagacgatcagaggtaccgaacccaaccgcattaccggctcgagctgcacagtagacttcgcaagtgccgtcagaagagtttgatgcattgtgagctgtgaaggtgccagaaggagcgggatgctcctcagctcgtctgccgaaactctctcggcctgaggcgcaaaattcagcttcctattgacgatcaggacgacgtcttcgctgcggccaattagtagagagcctacttgcggatcgatcctaccaacgacagcaatattgaaacggccggttagaacgccatgatgcagtacatgtcgagggccctccacaacctcgatttggcagttcggaaattcattgtgaaatgcgctaagcgccacggccatgcattcggacgtcaaggaatctgcgctccaactcaccggtaacgcaatccgaattgattgttcaaaggccgcagctatgtggcttcgttcgcccagagtgtcgttgaaagccctctcaacgccgacaaacagcgaatgcagcctttcagcatcatcggtcggttcagaaccggtcttcttccggtcgataagccttgtcccgagcgcatattcgatctgttcaagctgggccggtatcatcggagcagtccgtccggcgacgcgggcagcgctcgccatgctgccggtctgcaccacacgattcacggtagaaatctgcttcaggctaaccttgggatggaaattcgtggcttcggaccagcccgaaggggcctcgacgcctttgcggacatcatttagcagatttaacagaagttcatggtcgttagagagctctgcggtcacgcagcacgacggactgcgaattaccggaaccgcagtgatgccctggatgcgaagacgctggggtacagtcagttggggcagaagtagatccgacttgcggatgtcgtcgatgagccctcggagatcctgcagacttcgatcggtggtggaaatccgtgatgtcgcgataccgctggagcggtcgaatttcgtgtcgctttgcagtgtacccggcagatcgggaatttcggtttttggagcaatgtcaccacgctcgggtcgctccccaaccgtatgggtcagcctcgtccaatggtctggagcaacgacaacagaaggtccggataccccagtaccgatggtatgttggatcttgagctgcccgagtggcaccgcgtctgacagaagatggctgggaccgttctgcattccgaaggcgccagtacccgtgaagatcaagtctacataagggtggtcgggtttggaatggaagcggcggatcgccgtgattacagcgtaggaaattgctgtccaggtatagtcaacgtctaatttgaggatgacgggcgccgaaggcgccgcgctgccgccaagtttggcatgactcaaatattcctcggcaaggaggagacgaacactgcgattgtacagccagaccgccgagcgtagcggaaaggagttacgccctttgcgaccaaaaagcgtcactccaatctgggcttcgagcgtgctgagcttggcactcaatgccgccgttaattaaccaagctt

We claim:

1. A method for producing a transgenic plant cell or a transgenic plant, comprising:
   a) providing bacteria of a transgenic non-pathogenic strain variant of *Agrobacterium* strain K599 (NCPPB 2659) which comprise a genome comprising a 16S-23S rRNA intergenic sequence comprising at least one sequence motif selected from the group consisting of SEQ ID NO:5, 6, 7, 8, 9, 10, 11, 12, 13, and 14, wherein said strain variant is capable to infect plant cells, to mediate T-DNA transfer into plant cells, and to mediate T-DNA insertion into the plant genome, but is lacking hairy root phenotype inducing properties, and wherein said strain variant further comprises a transgenic T-DNA,
   b) co-cultivating a plant, plant cell or plant tissue with said bacteria, and
   c) isolating or selecting plant cells comprising stably integrated into their genome said transgenic T-DNA, and optionally
   d) regenerating plants comprising stably integrated into their genome said transgenic T-DNA.

2. The method of claim 1, wherein said non-pathogenic strain variant comprises a non-pathogenic plasmid variant of the Ri-plasmid pRi2659.

3. The method of claim 2, wherein the non-pathogenic plasmid variant
   (a) encodes a virD2 protein, the amino acid sequence of which comprises the sequence of SEQ ID NO: 112, or
   (b) comprises the sequence of SEQ ID NO: 24.

4. The method of claim 1, wherein said transgenic T-DNA comprises at least one plant expressible selectable marker gene.

5. The method of claim 4, wherein said plant cell, plant tissue, or plant is derived from a plant selected from the group consisting of monocotyledonous plants, dicotyledonous plants, and gymnosperm plants.

6. The method of claim 5, wherein said plant is from a genus selected from the group consisting of *Medicago, Lycopersicon, Brassica, Cucumis, Solanum, Juglans, Gossypium, Malus, Vitis, Antirrhinum, Populus, Fragaria, Arabidopsis, Picea, Capsicum, Chenopodium, Dendranthema, Pharbitis, Pinus, Pisum, Oryza, Zea, Triticum, Triticale, Secale, Lolium, Hordeum, Glycine, Pseudotsuga, Kalanchoe, Beta, Helianthus,* and *Nicotiana*.

7. A non-pathogenic strain variant of *Agrobacterium* strain K599 (NCPPB 2659) which comprises a genome comprising a 16S-23S rRNA intergenic sequence comprising at least one sequence motif selected from the group consisting of SEQ ID NO:5, 6, 7, 8, 9, 10, 11, 12, 13, and 14, wherein said strain variant is capable to infect plant cells, to mediate T-DNA transfer into plant cells, and to mediate T-DNA insertion into the plant genome, but is lacking hairy root phenotype inducing properties.

8. A transgenic non-pathogenic strain variant of *Agrobacterium* strain K599 (NCPPB 2659) which comprises a genome comprising a 16S-23S rRNA intergenic sequence comprising at least one sequence motif selected from the group consisting of SEQ ID NO:5, 6, 7, 8, 9, 10, 11, 12, 13, and 14, wherein said strain variant is capable to infect plant cells, to mediate T-DNA transfer into plant cells, and to mediate T-DNA insertion into the plant genome, but is lacking hairy root phenotype inducing properties, and wherein said strain variant further comprises a transgenic T-DNA.

9. The non-pathogenic strain variant of claim 7, wherein said strain variant comprises a non-pathogenic plasmid variant of the Ri-plasmid pRi2659.

10. The non-pathogenic strain variant of claim 8, wherein said strain variant comprises a non-pathogenic plasmid variant of the Ri-plasmid pRi2659.

11. The non-pathogenic strain variant of claim 9, wherein the non-pathogenic plasmid variant
    (a) encodes a virD2 protein, the amino acid sequence of which comprises the sequence of SEQ ID NO: 112, or
    (b) comprises the sequence of SEQ ID NO: 24.

12. The non-pathogenic strain variant of claim 10, wherein the non-pathogenic plasmid variant
    (a) encodes a virD2 protein, the amino acid sequence of which comprises the sequence of SEQ ID NO: 112, or
    (b) comprises the sequence of SEQ ID NO: 24.

13. The non-pathogenic strain variant of claim 8, wherein said transgenic T-DNA comprises at least one plant expressible selectable marker gene.

\* \* \* \* \*